US010233452B2

(12) United States Patent
Kaelin, Jr. et al.

(10) Patent No.: US 10,233,452 B2
(45) Date of Patent: *Mar. 19, 2019

(54) COMPOSITIONS AND METHODS FOR INCREASING ERYTHROPOIETIN (EPO) PRODUCTION

(71) Applicants: ALNYLAM PHARMACEUTICALS, INC., Cambridge, MA (US); DANA-FARBER CANCER INSTITUTE, Boston, MA (US)

(72) Inventors: William G. Kaelin, Jr., Boston, MA (US); Victor Kotelianski, Newton, MA (US); William Querbes, Boston, MA (US); Brian Bettencourt, Groton, MA (US)

(73) Assignees: Dana-Farber Cancer Institute, Inc., Boston, MA (US); Alnylam Pharmaceuticals, Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/886,550

(22) Filed: Oct. 19, 2015

(65) Prior Publication Data

US 2016/0177313 A1    Jun. 23, 2016

Related U.S. Application Data

(63) Continuation of application No. 13/992,334, filed as application No. PCT/US2011/064121 on Dec. 9, 2011, now Pat. No. 9,193,973.

(60) Provisional application No. 61/421,727, filed on Dec. 10, 2010, provisional application No. 61/493,651, filed on Jun. 6, 2011.

(51) Int. Cl.
    *C12N 15/11*    (2006.01)
    *C12N 15/113*    (2010.01)
    *A61K 31/713*    (2006.01)

(52) U.S. Cl.
    CPC ........ *C12N 15/1137* (2013.01); *A61K 31/713* (2013.01); *C12N 2310/14* (2013.01); *C12N 2310/315* (2013.01); *C12N 2310/321* (2013.01); *C12N 2310/335* (2013.01); *C12N 2310/344* (2013.01); *C12N 2320/31* (2013.01); *C12Y 114/11002* (2013.01)

(58) Field of Classification Search
None
See application file for complete search history.

(56) References Cited

U.S. PATENT DOCUMENTS

| | | | |
|---|---|---|---|
| 2003/0100605 A1* | 5/2003 | Grupp | A61K 31/336 514/475 |
| 2004/0014064 A1* | 1/2004 | Brissette | C12Q 1/6883 435/6.11 |
| 2005/0246794 A1 | 11/2005 | Khvorova et al. | |
| 2005/0255487 A1 | 11/2005 | Khvorova et al. | |
| 2007/0293575 A1* | 12/2007 | Seeley | A61K 31/47 514/566 |
| 2008/0113351 A1* | 5/2008 | Naito | A61K 31/713 435/6.11 |
| 2009/0176726 A1 | 7/2009 | Fisher et al. | |
| 2009/0203135 A1 | 8/2009 | Forst et al. | |
| 2009/0209626 A1* | 8/2009 | Khvorova | C12N 15/111 514/44 A |
| 2010/0267806 A1 | 10/2010 | Bumcrot et al. | |

FOREIGN PATENT DOCUMENTS

| | | | |
|---|---|---|---|
| WO | 2005116204 A1 | 12/2005 | |
| WO | 2007005504 A2 | 1/2007 | |
| WO | 2009002533 A1 | 12/2008 | |
| WO | WO-2009143372 A2 * | 11/2009 | ......... C12N 15/1135 |
| WO | 2010022240 A1 | 2/2010 | |
| WO | 2010030396 A2 | 3/2010 | |
| WO | 2010084134 A1 | 7/2010 | |
| WO | 2012027467 A1 | 3/2012 | |

OTHER PUBLICATIONS

Berra, E., et al. "HIF prolyl-hydroxylase 2 is they key oxygen sensor selling low steady-state levels of HIF-1α in normoxia" (2003) The EMBO Journal 22(16):4082-4090.
Elbashir, S. M., et al. "Functional anatomy of siRNAs for mediating efficient RNAi in *Drosophila melanogaster* embryo lysate" (2001) The EMBO Journal 20(23):6877-6888.
Wu, S., et al. "Enhancement of Angiogenesis Through Stabilization of Hypoxia-inducible Factor-1 by Silencing Prolyl Hydroxylase Domain-2 Gene" (2008) Molecular Therapy 16(7):1227-1234.
International Preliminary Report on Patentability for International Application No. PCT/US2011/064121, dated Jun. 20, 2013.
Extended European Search Report from EP Application No. 11846890. 9, entitled "Compositions and Methods For Increasing Erythropoietin (EPO) Production," dated Apr. 2, 2015.

* cited by examiner

*Primary Examiner* — Ekaterina Poliakova-Georgantas
(74) *Attorney, Agent, or Firm* — Fish & Richardson P.C.

(57) ABSTRACT

The invention relates to double-stranded ribonucleic acid (dsRNA) compositions targeting one or more EGLN genes, EGLN1, EGLN2 and/or EGLN3 and methods of using such dsRNA compositions to inhibit expression of these genes.

25 Claims, 26 Drawing Sheets

Specification includes a Sequence Listing.

COMPOSITIONS AND METHODS FOR INCREASING ERYTHROPOIETIN (EPO) PRODUCTION

CROSS REFERENCE TO RELATED APPLICATIONS

This application is a continuation of U.S. application Ser. No. 13/992,334 filed Sep. 23, 2013, entitled Compositions and Methods for Increasing Erythropoietin (EPO) Production, which is a 35 U.S.C. § 371 U.S. National Stage Entry of International Application No. PCT/US2011/064121 filed Dec. 9, 2011, entitled Compositions and Methods for Increasing Erythropoietin (EPO) Production, which claims the benefit of priority of U.S. Provisional Application No. 61/421,727 filed Dec. 10, 2010, entitled Compositions and Methods for Increasing Erythropoietin (EPO) Production, and U.S. Provisional Application No. 61/493,651 filed Jun. 6, 2011, entitled Compositions and Methods for Increasing Erythropoietin (EPO) Production, the contents of which are each incorporated herein by reference in its entirety.

STATEMENT REGARDING FEDERALLY SPONSORED RESEARCH OR DEVELOPMENT

This invention was made with government support under grant number CA068490 awarded by The National Institutes of Health. The government has certain rights in the invention.

REFERENCE TO SEQUENCE LISTING

The present application is being filed along with a Sequence Listing in electronic format. The Sequence Listing is provided as a file entitled 20021004USCONSEQLST.txt created on Feb. 17, 2016 which is 924,566 bytes in size. The information in electronic format of the sequence listing is incorporated herein by reference in its entirety.

FIELD OF THE INVENTION

The invention relates to the specific inhibition of the expression of EGLN genes.

BACKGROUND OF THE INVENTION

Erythropoietin (EPO) is a hormone found in the plasma which regulates red cell production by promoting erythroid differentiation and initiating hemoglobin synthesis. The gene is in the EPO/TPO family and encodes a secreted, acidic glycosylated cytokine.

Recombinant human erythropoietin (EPO) has been used since 1986 to treat the anemia of chronic and end-stage kidney disease (Eschbach, et al., *N. Engl. J Med.* 1987 Jan. 8; 316(2):73-8). However, this treatment is costly and requires parenteral administration. It has recently been linked to cardiovascular side effects (J. Bohlius et al., *Lancet* 373, 1532 (2009) and antibodies which form against EPO can result in Pure Red Cell Aplasia (PRCA), an uncommon condition which develops in association with a failure of the bone marrow to manufacture red blood cells, leaving patients with severe, treatment-resistant anemia (reported by Casadevall, et al, *New England Journal of Medicine*, Feb. 14, 2002).

In addition to its role as a kidney cytokine regulating hematopoiesis, EPO is also produced in the brain after oxidative or nitrosative stress. The transcription factor HIF1 (hypoxia inducible factor 1) is known to upregulate EPO following hypoxic stimuli (Digicaylioglu, M., Lipton, S. A. *Nature* 412: 641-647, 2001). This upregulation provides protection against apoptosis of erythroid progenitors in bone marrow and also apoptosis of brain neurons (Siren, A.-L., et al., *Proc. Nat. Acad. Sci.* 98: 4044-4049, 2001). Grimm et al. showed in the adult mouse retina that acute hypoxia dose-dependently stimulates expression of EPO, fibroblast growth factor-2, and vascular endothelial growth factor via HIF1 stabilization (*Nature Med.* 8: 718-724, 2002).

Further controlling the regulation of EPO production are a family of prolyl hydroxylases, the PHD proteins, which act to regulate the HIF transcription factors. PHD (prolyl hydroxylases) proteins belong to a superfamily of several 2-oxoglutarate-dependent dioxygenases (Kaelin Jr., and Ratcliffe, *Mol. Cell* 30, 393 (2008). In the mouse, these genes are known as EGLN1 (PHD2, prolyl hydroxylase domain-containing protein 2 and by the synonyms hif-prolyl hydroxylase 2; hifph2; hph2; chromosome 1 open reading frame 12; c1orf12; sm20, rat, homolog of; sm20; zinc finger mynd domain-containing protein 6; and zmynd6), EGLN2 (PHD1, prolyl hydroxylase domain-containing protein 1; and by the synonyms hif-prolyl hydroxylase 1; hifph1) and EGLN3 (PHD3 prolyl hydroxylase domain-containing protein 3; and by the synonyms hif-prolyl hydroxylase 3; hifph3). In an attempt to elucidate the function of PHD enzymes in hepatic EPO production, Minamishima et al., created knockout mice lacking liver expression of PHD1, PHD2, PHD3, or combinations thereof (*Mol. Cell. Biol.* 29, 5729 (2009)).

Subsequent studies by Minamishima and Kaelin using the knock-out model, suggested that while hepatic inactivation of PHD1, PHD2, or PHD3 alone did not increase EPO or hematocrit values, loss of all three PHDs increased both measurements (*Science,* 329, 407 and Supplemental Information (2010)). According to Minamishima, questions remain regarding the promoters used and the role that PHD2 plays (and at which developmental stage) independent of the other two enzymes in the activation of EPO production.

Double-stranded RNA molecules (dsRNA) have been shown to block gene expression in a highly conserved regulatory mechanism known as RNA interference (RNAi). This natural mechanism has now become the focus for the development of a new class of pharmaceutical agents for treating disorders that are caused by the aberrant or unwanted regulation of a gene.

Given the drawbacks of complete gene knockout and the inherent problems translating gene knockout to human therapy, the present invention contemplates the use of RNAi to effect gene modulation with improved outcomes in the production of erythropoietin.

During development the liver is the major source of EPO but over time eventually the liver EPO is switched off and in normal healthy adults their kidney makes the EPO to support normal red blood cell production. However, two to four million Americans with renal disease suffer from anemia due to impaired EPO production. If it is possible to turn on hepatic EPO using siRNA targeting EGLN genes the liver could now supply the EPO required to support red blood cell production to compensate for the damaged kidney function. Furthermore, using siRNA in LNPs it may be possible to activate fetally expressed genes in liver by targeting negative regulators of the pathway. This strategy could be used in the treatment of many other diseases and not just exclusively anemia.

SUMMARY OF THE INVENTION

Described herein are compositions and methods that effect the RNA-induced silencing complex (RISC)-mediated cleavage of RNA transcripts of one or more of the EGLN genes, such as in a cell or mammal. Also described are compositions and methods for treating pathological conditions and diseases caused by or associated with the expression of said genes, such as anemia, hypoxia, neurological conditions including degeneration, renal disease or failure, and cancers including those of the blood, bone and marrow. It has been discovered that synergistic effects are seen upon the administration of a mix or plurality of iRNA agents collectively targeting all three EGLN genes.

As used herein, the term "iRNA" refers to one or more agents that contain RNA as that term is defined herein, and which mediates the targeted cleavage of an RNA transcript via an RNA-induced silencing complex (RISC) pathway. In one embodiment, an iRNA as described herein effects inhibition of expression of at least one EGLN gene in a cell or mammal. Alternatively, in another embodiment, an iRNA as described herein activates EGLN expression in a cell or mammal. It should be understood that as used herein the term "EGLN" refers to any of the EGLN genes in any mammalian species and having any of the synonyms referred to in the art. Where a specific species or gene variant is being referred to, the variant will be called out by name.

The iRNAs included in the compositions featured herein encompass a dsRNA having an RNA strand (the antisense strand) having a region that is 30 nucleotides or less, generally 19-24 nucleotides in length, that is substantially complementary to at least part of an mRNA transcript of an EGLN gene.

In one embodiment, an iRNA for inhibiting expression of an EGLN gene includes at least two sequences that are complementary to each other. The iRNA includes a sense strand having a first sequence and an antisense strand having a second sequence. The antisense strand includes a nucleotide sequence that is substantially complementary to at least part of an mRNA encoding EGLN, and the region of complementarity is 30 nucleotides or less, and at least 15 nucleotides in length. Generally, the iRNA is 19 to 24, e.g., 19 to 21 nucleotides in length. In some embodiments the iRNA is from about 15 to about 25 nucleotides in length, and in other embodiments the iRNA is from about 25 to about 30 nucleotides in length. The iRNA, upon contacting with a cell expressing EGLN, inhibits the expression of an EGLN gene by at least 10%, at least 20%, at least 25%, at least 30%, at least 35% or at least 40% or more, such as when assayed by a method as described herein. In one embodiment, where contacting is by a mix or plurality of EGLN iRNAs, the expression of each EGLN gene is inhibited by at least 10%, at least 20%, at least 25%, at least 30%, at least 35% or at least 40% or more and inhibition need not be the same for each EGLN targeted by the mix. For example, a mix of iRNAs targeting EGLN1, 2 and 3 may result in inhibition of expression of EGLN1 by 10%, EGLN2 by 20% and EGLN3 by 10%. As such, the mix inhibits EGLN expression by at least 10%. In one embodiment, the EGLN iRNA or iRNAs are formulated in a stable nucleic acid lipid particle (SNALP).

The details of various embodiments of the invention are set forth in the description below. Other features, objects, and advantages of the invention will be apparent from the description and the drawings, and from the claims.

BRIEF DESCRIPTION OF THE DRAWINGS

FIG. 4A shows a histogram of EPO production in pg/mL Erythropoietin production upon treatment with EGLN dsRNA. FIG. 4B shows a histogram of the ELISA results of treatment groups PBS (1-4 and average), Luciferase control (AD1955) (1-5 and average) and the 3-iRNA mix of EGLN 1, 2 and 3 targeting agents, AD-40894, AD-40773 and AD40758, respectively (1-5 and average). Each bar (except for the averages) represents an individual animal.

and a trip iRNA agent mix (AD-40894, AD-40773 and AD-40758 is "EGLN 1+2+3").

Figure 12:
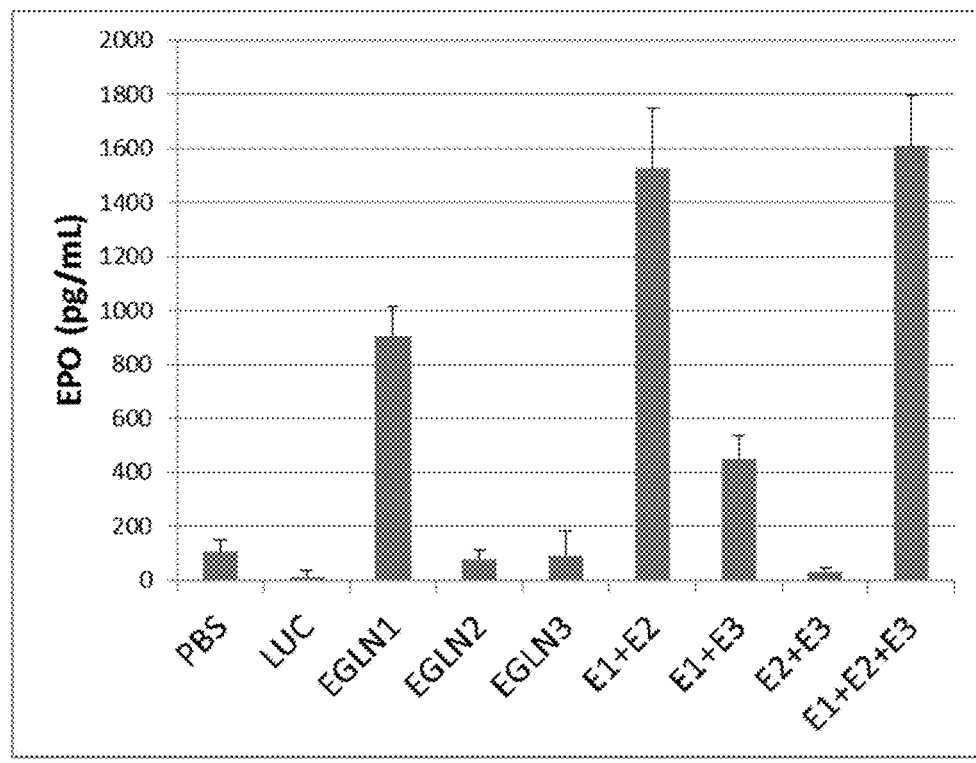
Figure 12:
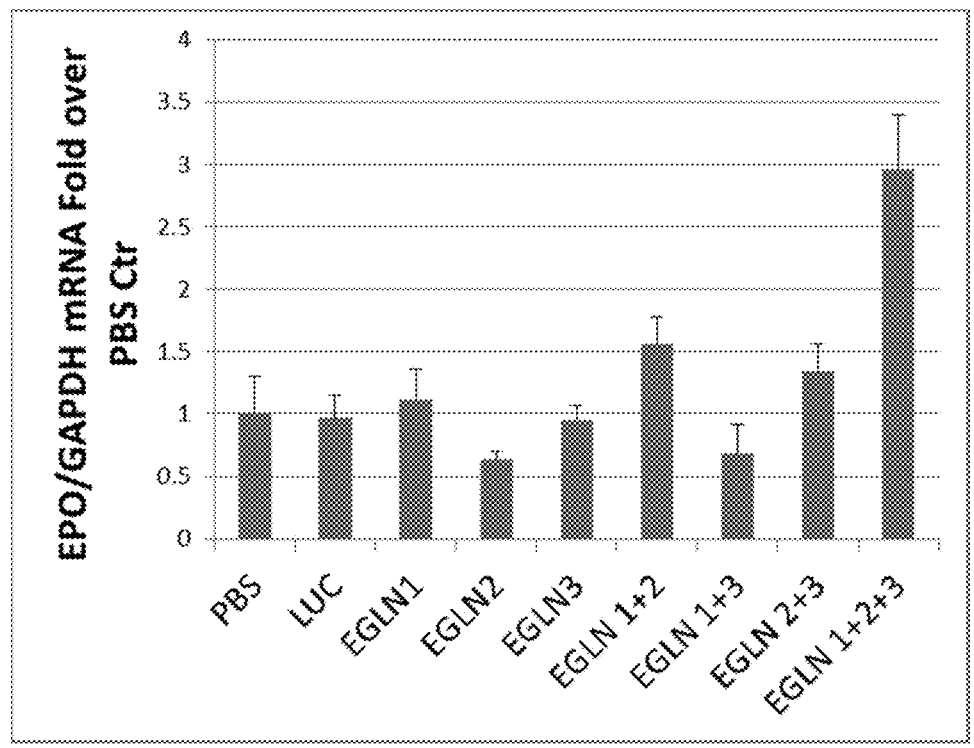

FIG. 12 is a histogram showing the effects on erythropoietin production by the iRNA agents of the invention in a dose response study (mg per kg). Panel 1 shows a histogram of the ELISA results of treatment groups PBS, Luciferase control (AD1955), single iRNA agent mixes, dual iRNA agent mixes and triple iRNA mixture. Panel 2 shows the increase of EPO mRNA in the iRNA mixtures which contain the EGLN1 iRNA agent (AD-40773) from the treatment groups PBS, Luciferase control (AD1955), single iRNA agent mixes, dual iRNA agent mixes and triple iRNA mixture. It is to be noted that E1 means the same as EGLN1, E2 means the same as EGLN2 and E3 means EGLN3.

Figure 13:
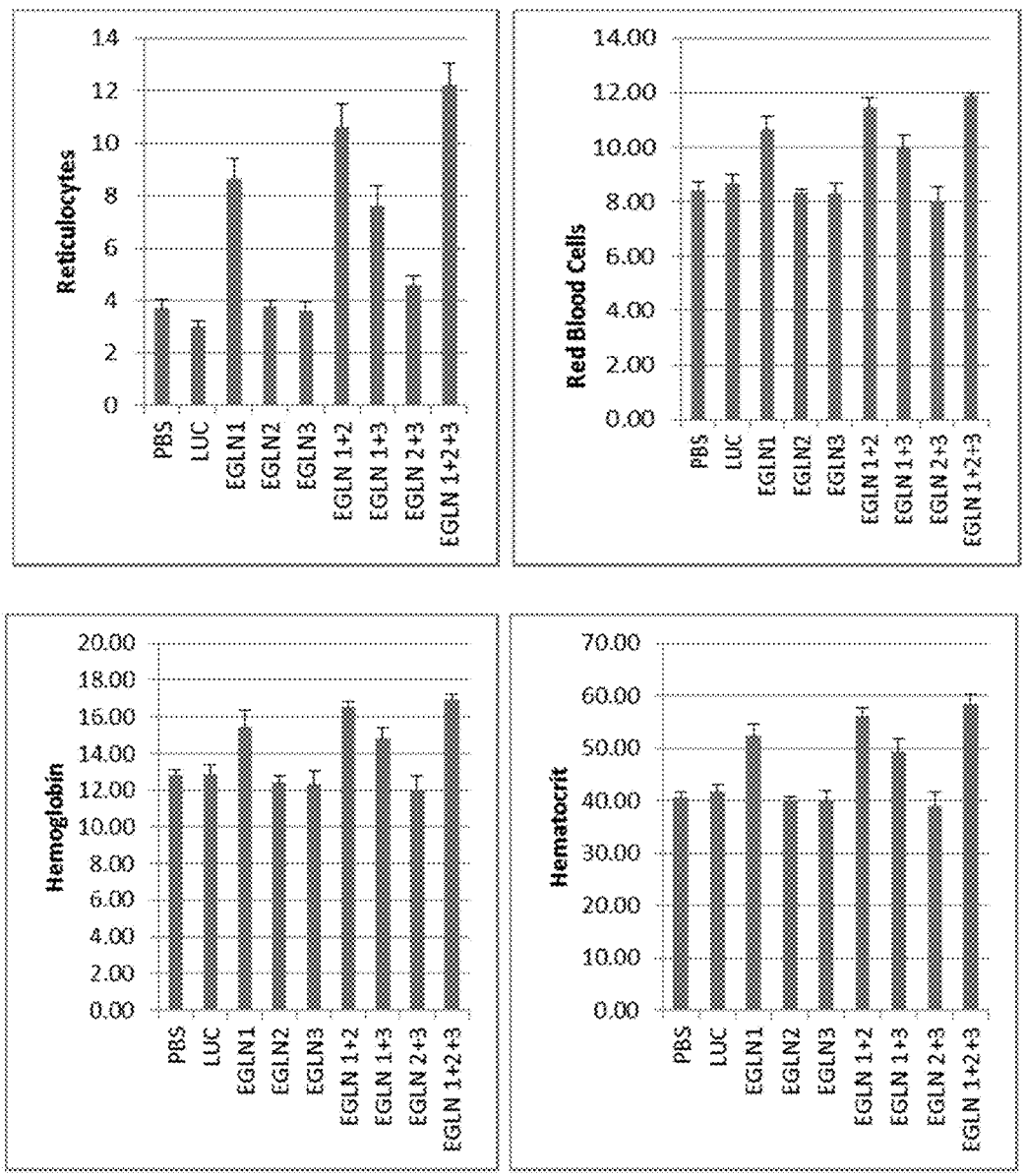

FIG. 13 is a histogram of the hematology results showing hemoglobin, hematocrit, reticulocyte and red blood cell levels upon a two dose treatment with a composition of single iRNA agents, dual iRNA agents or a triple iRNA agent mixture, a luciferase control iRNA agent and PBS control.

Figure 14:
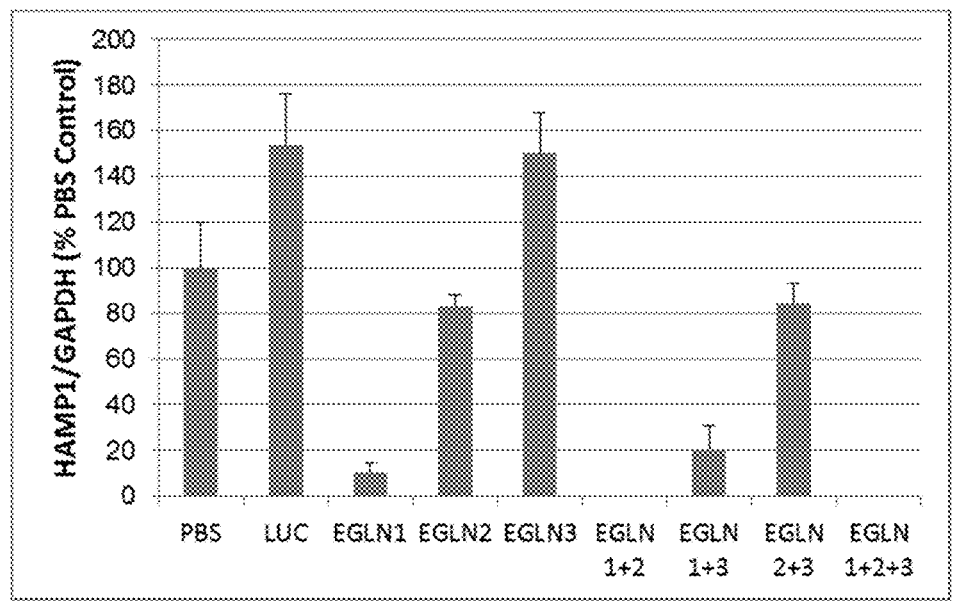

FIG. 14 is a histogram of the regulation of hepcidin upon a two dose treatment with a composition of single iRNA agents, dual iRNA agents or a triple iRNA agent mixture, a luciferase control iRNA agent and PBS control.

Figure 15:
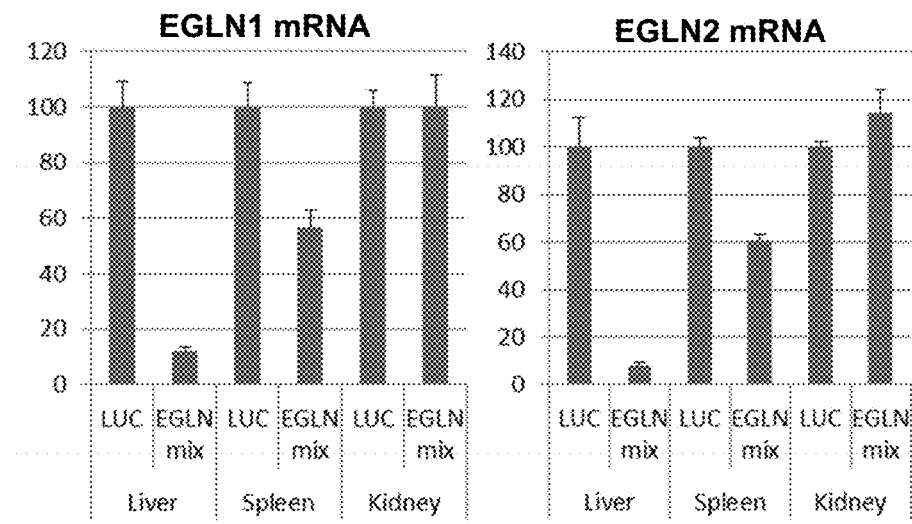
Figure 15:
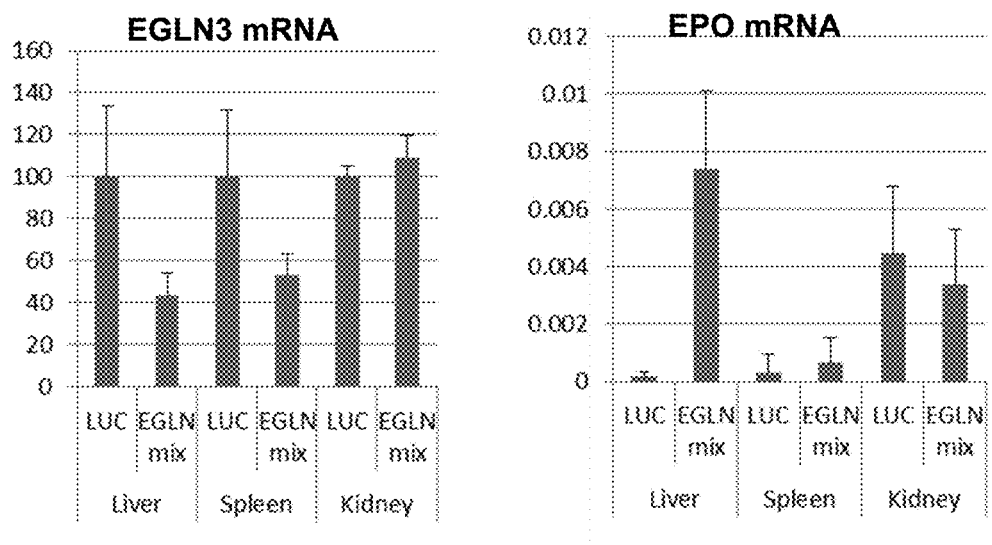

FIG. 15 is a histogram showing tissue specificity in a dose response study (mg per kg). Panel 1 shows a histogram of the results of treatment groups Luciferase control (AD1955 is "LUC"), and a triple iRNA mixture (AD-40894, AD-40773 and AD-40758 is "EGLN mix") on EGLN1 found in the liver, kidney and spleen. Panel 2 shows a histogram of the results of treatment groups Luciferase control (AD1955 is "LUC"), and a triple iRNA mixture (AD-40894, AD-40773 and AD-40758 is "EGLN mix") on EGLN2 found in the liver, kidney and spleen. Panel 3 shows a histogram of the results of treatment groups Luciferase control (AD1955 is "LUC"), and a triple iRNA mixture (AD-40894, AD-40773 and AD-40758 is "EGLN mix") on EGLN3 found in the liver, kidney and spleen. Panel 4 shows an increase of EPO mRNA in the liver from the triple iRNA mixture (AD-40894, AD-40773 and AD-40758 is "EGLN mix") as compared to the Luciferase control (AD1955 is "LUC") which was not seen in the kidney or spleen. The y-axis represents ratio of EPO to GAPDH mRNA levels in arbitrary units.

Figure 16:
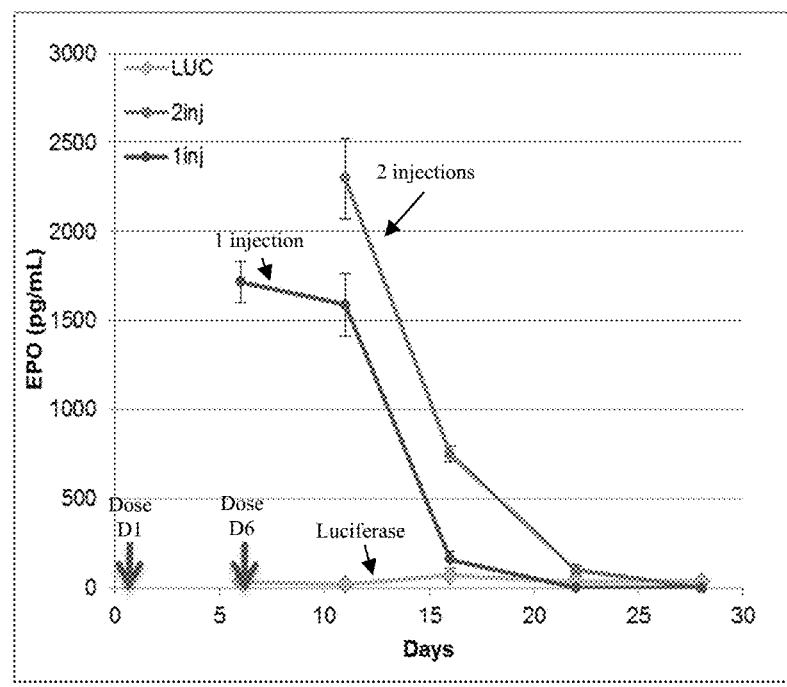
Figure 16:
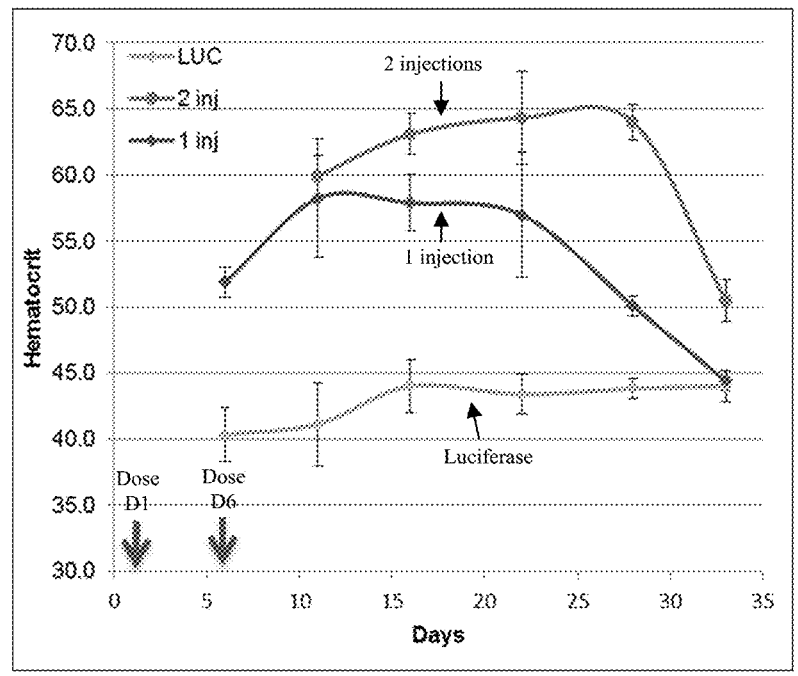

FIG. 16 is a line graph showing the durable effects of a cocktail (AD-40894 at 0.375 mg/kg, AD-40773 at 0.75 mg/kg and AD-40758 at 0.375 mg/kg) in a single dose injection or a double dose injection as compared to a Luciferase control (AD1955). Panel 1 shows the levels of EPO found after a single or double injection as compared to the control (LUC). Panel 2 shows that the injection of the cocktail can increase the amount hematocrit in the mouse for about a month after a single injection.

Figure 17:
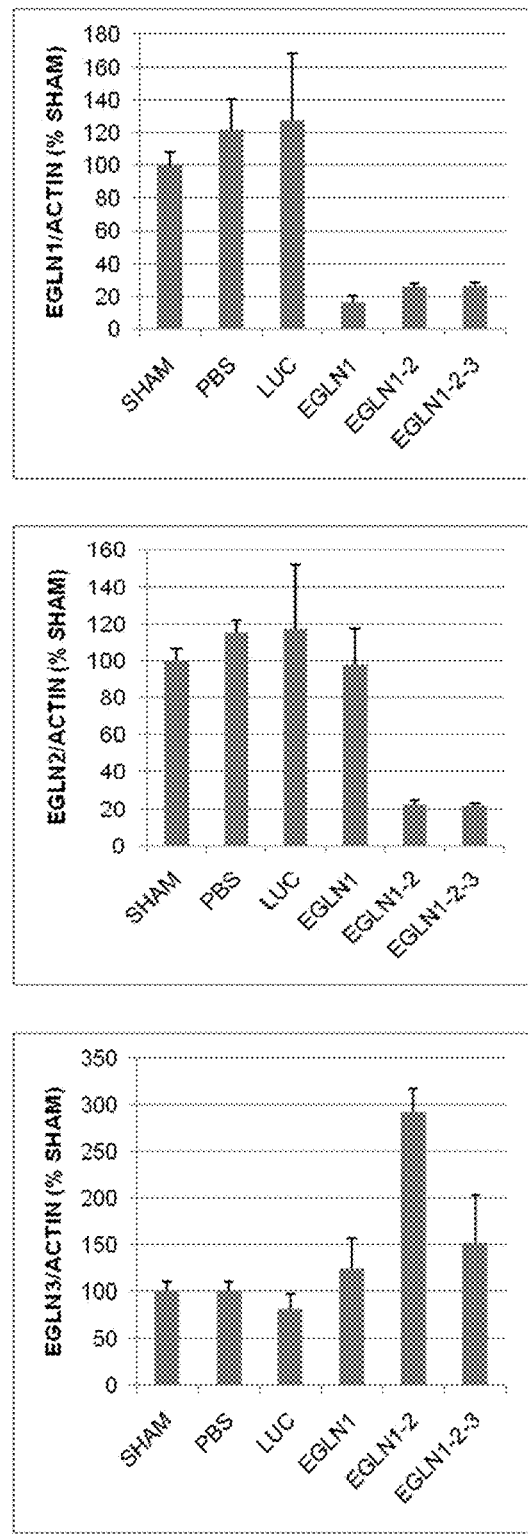

FIG. 17 is a histogram showing knockdown of EGLN genes by the iRNA agents of the invention. Panel 1 shows the specificity of the EGLN1 iRNA agent, AD-40894 for EGLN1 (AD-40894), EGLN1-2 (mix of AD-40894 and AD-40773) and the effect of the 3-iRNA mix. Panel 2 shows the specificity of the EGLN2 iRNA agent, AD-40773 for EGLN1 (AD-40894), EGLN1-2 (mix of AD-40894 and AD-40773) and the effect of the 3-iRNA mix. Panel 3 shows the specificity of the EGLN3 iRNA agent, AD-40758 for EGLN1 (AD-40894), EGLN1-2 (mix of AD-40894 and AD-40773) and the effect of the 3-iRNA mix.

Figure 18:
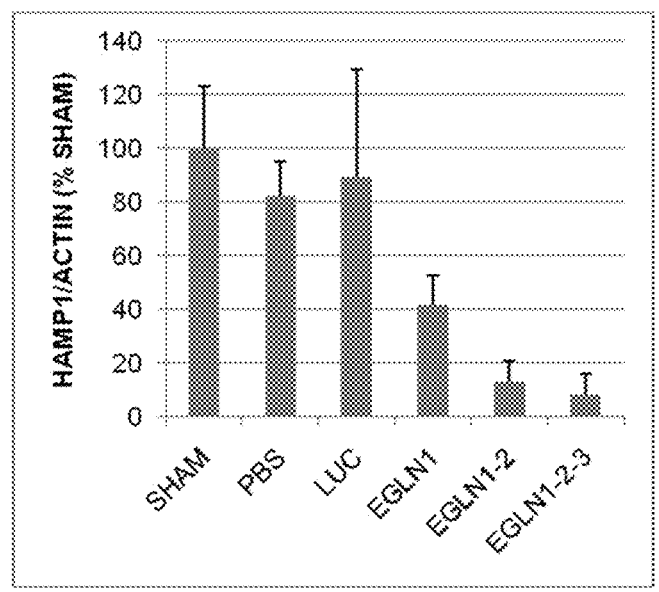

FIG. 18 is a histogram a summary of the downregulation of hepcidin by the iRNA agents of the invention.

Figure 19:
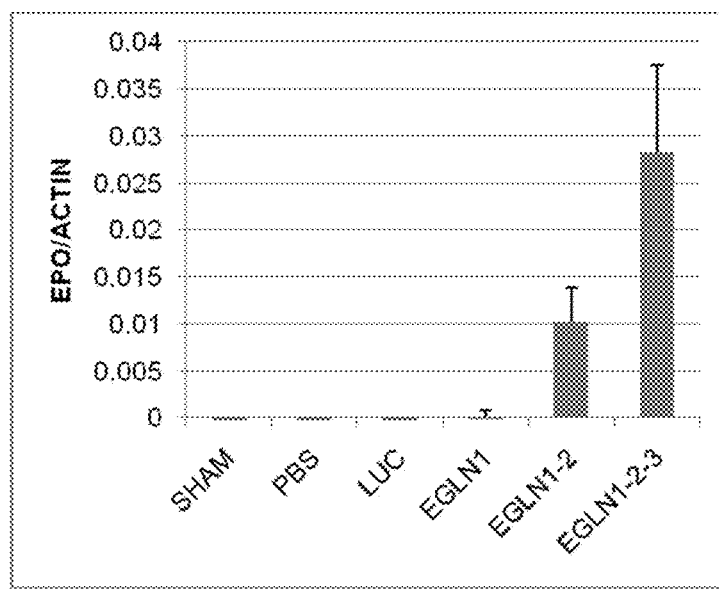

FIG. 19 is a histogram showing the increase of EPO mRNA after 3 doses at day 12 in the animals who received the EGLN1-2-3 (mix of AD-40894, AD-40773 and AD-40758).

Figure 20:
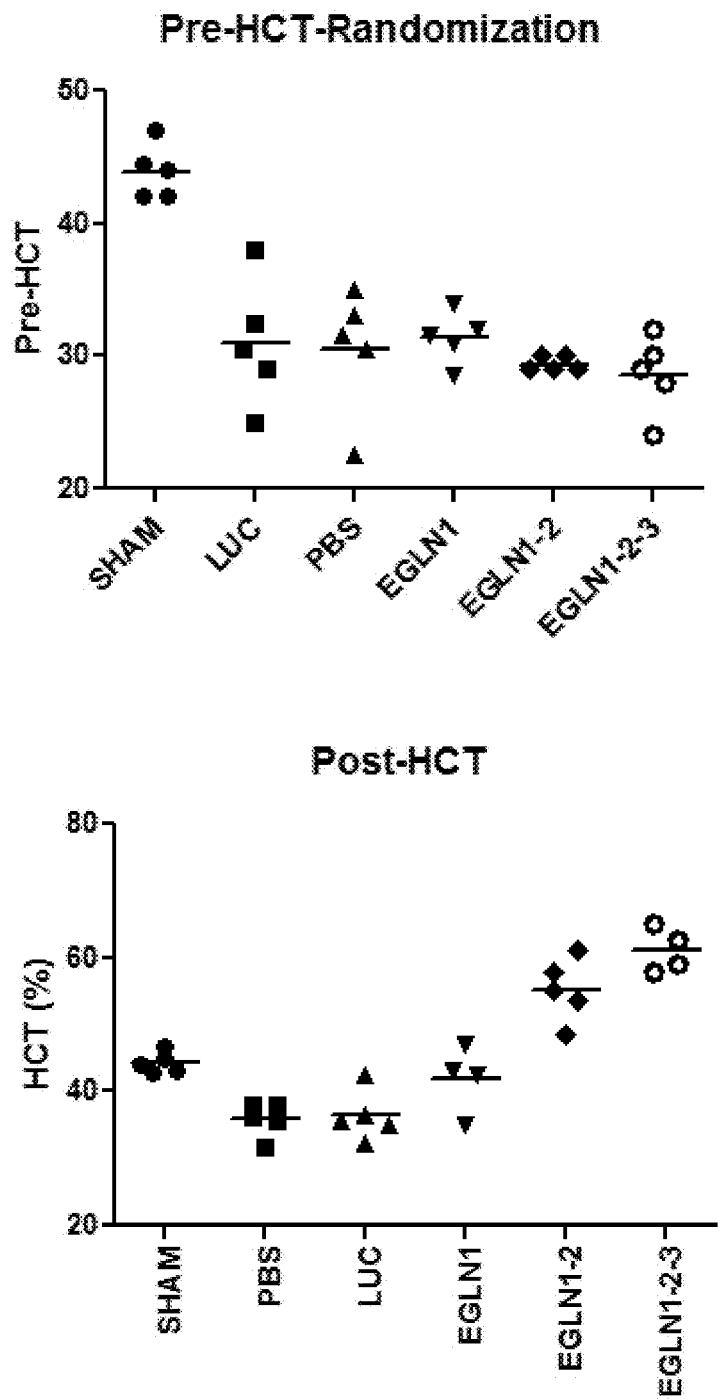

FIG. 20 is a scatter chart of the hematocrit levels for pre- and post-dose of the iRNA agents of the invention. Panel 1 is the baseline hematocrit levels of the animals at day 0. Panel 2 is the hematocrit levels of the animals on day 12.

Figure 21:
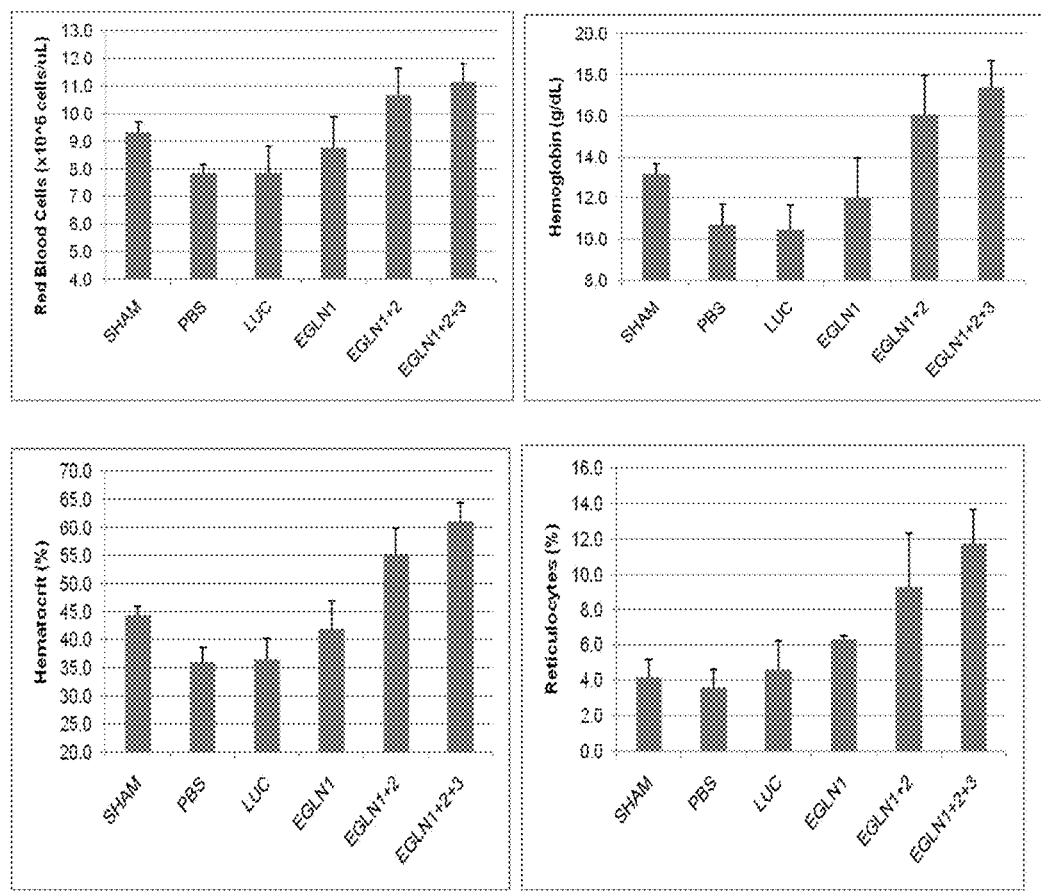

FIG. 21 is a histogram of the hematology results showing hemoglobin, hematocrit, reticulocyte and red blood cell levels upon a three dose treatment with a composition of a single iRNA agent (EGLN1), dual iRNA agent (EGLN1+2) or a triple iRNA agent mixture (EGLN1+2+3), a luciferase control iRNA agent, a PBS control and a SHAM control.

Figure 22:
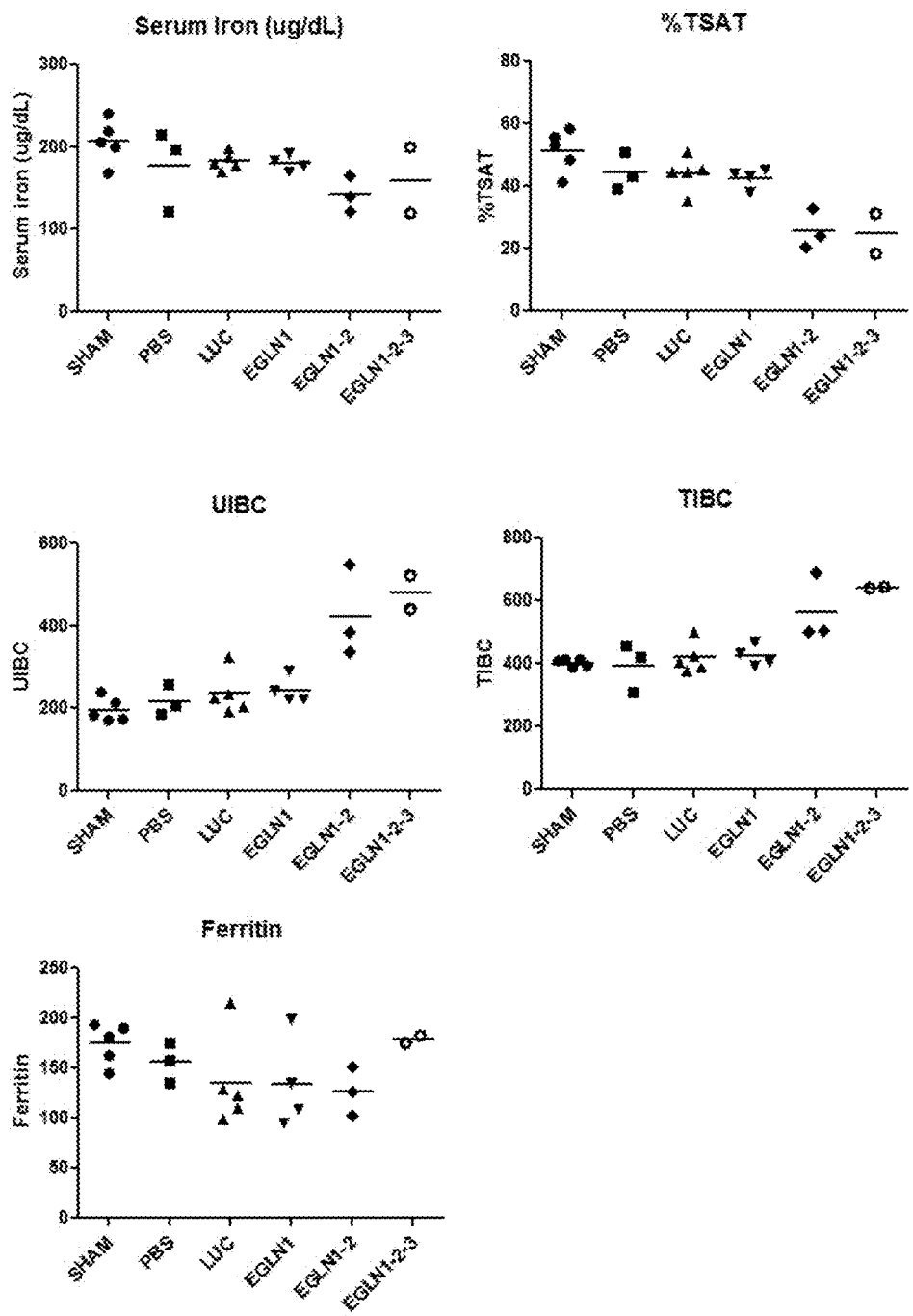

FIG. 22 is a scatter chart of the iron parameters of animals upon a three dose treatment with a composition of a single iRNA agent (EGLN1), dual iRNA agent (EGLN1-2) or a triple iRNA agent mixture (EGLN1-2-3), a luciferase control iRNA agent, a PBS control and a SHAM control. Panel 1 shows the serum levels of iron in the animals. Panel 2 shows the transferrin saturation (TSAT), which is the ratio of serum iron and total iron-binding capacity multiplied by 100, of the individual animals. Panel 3 is the unsaturated iron binding capacity (UIBC) of the animals. Panel 4 is the total iron binding capacity (TIBC) of the animals. Panel 5 shows the ferritin level of the animals.

Figure 23:
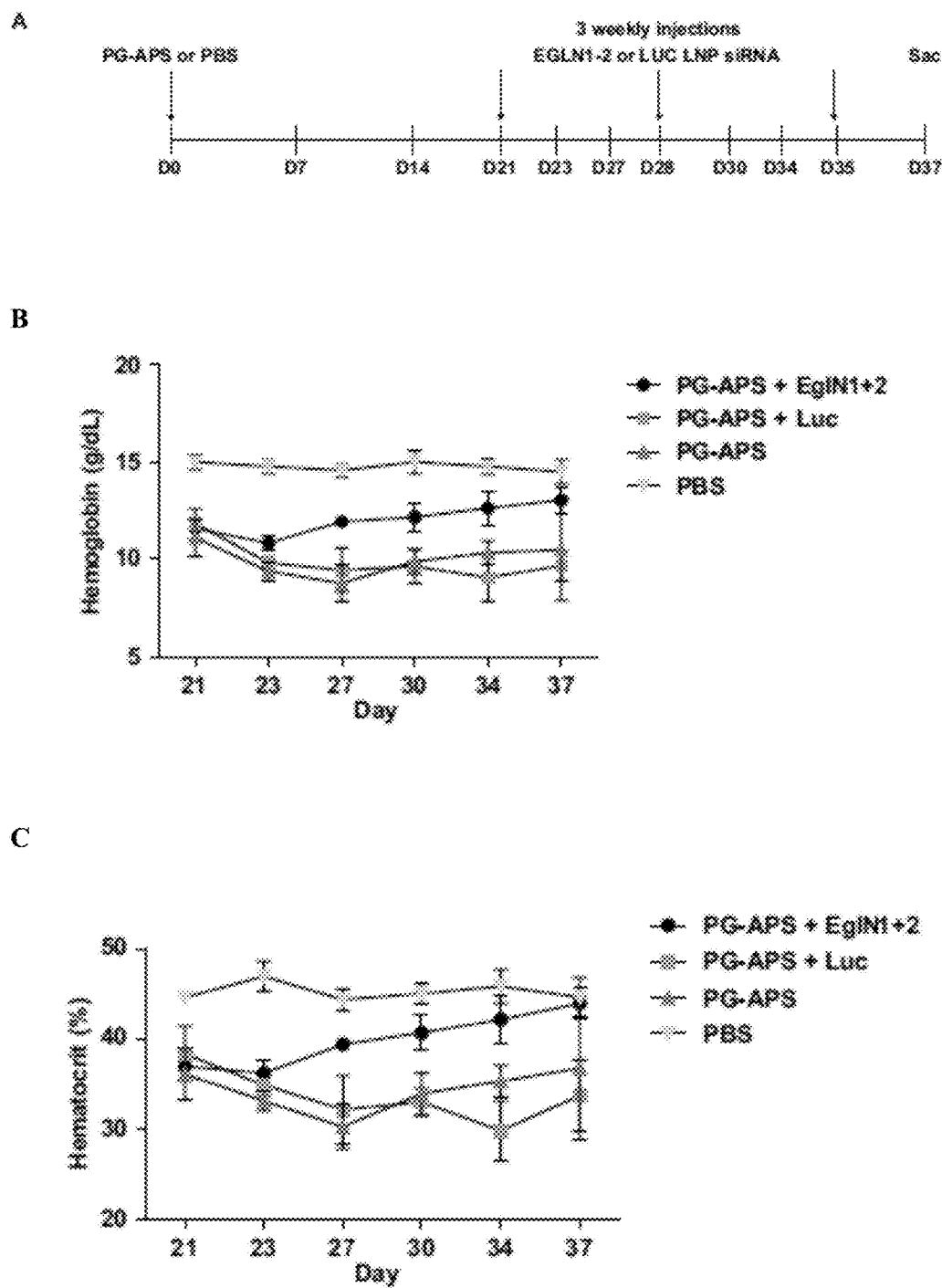

FIG. 23 shows the targeting of EglN genes rescues anemia caused by renal failure. (A) Overview of 5/6 nephrectomy procedure and dosing schedule. (B and C) Hemoglobin (B) and Hematocrit (C) levels in mice treated as depicted in (A).

Figure 24:
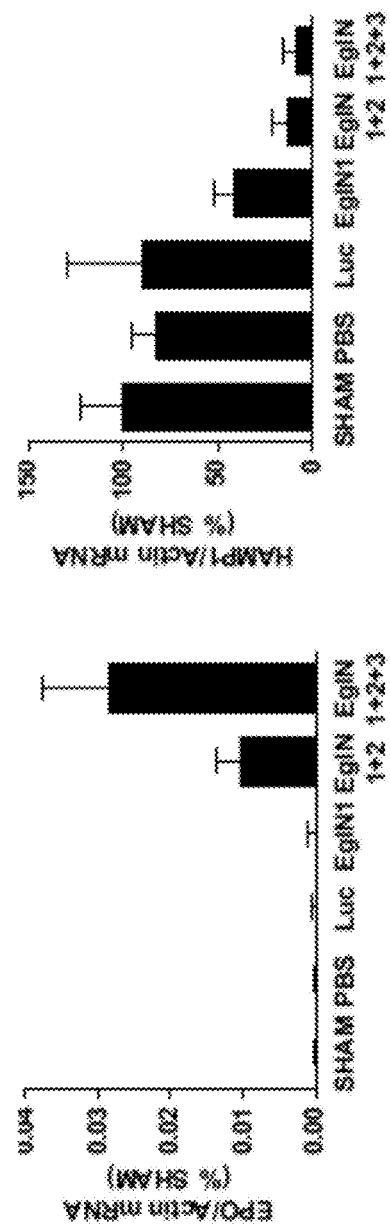

FIG. 24 shows histograms of the hematologic data showing EPO and HAMP1 mRNA values at day 12 in mice treated with the indicated siRNAs as depicted in (A). HAMP1=hepcidin antimicrobial peptide 1. mRNA levels were normalized to actin mRNA and then to corresponding sham mRNA level.

Figure 25:
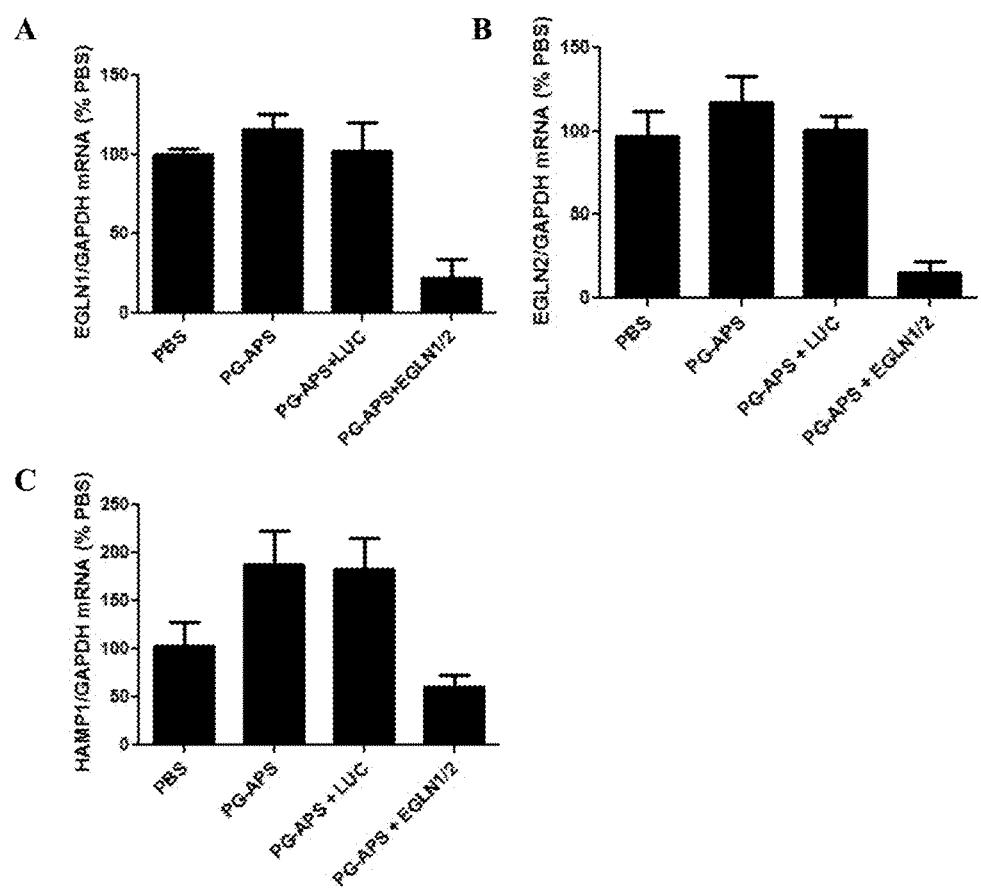

FIG. 25 is a histogram showing the reduction of anemia in rats. Panel A shows an effective knockdown of EGLN1 using the EGLN1/2 siRNAs of the present invention. Panel B shows an effective knockdown of EGLN2 using the EGLN1/2 siRNAs of the present invention. Panel C shows a decrease in hepcidin (HAMP1) levels in rats treated with the EGLN1/2 siRNAs of the present invention.

Figure 26:
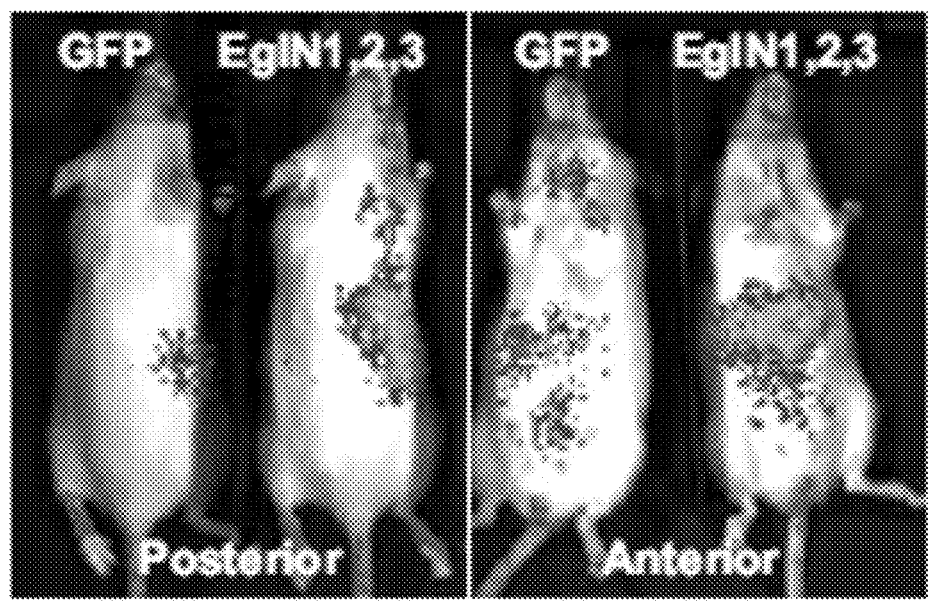

FIG. 26 shows bioluminescent images of HIF1alpha-Luc mice 72 hours after a single intravenous dose of LNPs targeting all three EglN family members or, as a negative control, green fluorescent protein (GFP). Total dose=1 mg/kg (0.33 mg/kg per family member).

DETAILED DESCRIPTION

Described herein are iRNAs and methods of using them for inhibiting the expression of one or more EGLN genes in a cell or a mammal where the iRNA targets the one or more EGLN genes. Also described are compositions and methods for treating pathological conditions and diseases caused by or associated with the expression of said genes, such as anemia, hypoxia, neurological conditions including degeneration, renal disease or failure, and cancers including those of the blood, bone and marrow. It has surprisingly been discovered that synergistic effects are seen upon the administration of a mix or plurality of iRNA agents collectively targeting all three EGLN genes.

The iRNAs of the compositions featured herein include an RNA strand (the antisense strand) having a region which is 30 nucleotides or less in length, i.e., 15-30 nucleotides in length, generally 19-24 nucleotides in length, which region is substantially complementary to at least part of an mRNA transcript of an EGLN gene. The use of these iRNAs enables the targeted degradation of mRNAs of genes that are implicated in pathologies associated with EGLN expression in mammals and with the signaling pathways involved in production of erythropoietin. Very low dosages of EGLN iRNAs in particular can specifically and efficiently mediate RNAi, resulting in significant inhibition of expression of one or more EGLN genes. Using cell-based assays, the present inventors have demonstrated that iRNAs targeting EGLN can specifically and efficiently mediate RNAi, resulting in significant inhibition of expression of an EGLN gene. More surprising is the discovery by the present inventors of a mix or cocktail of iRNA agents which can specifically target EGLN 1, 2 and 3 and which can increase or stimulate erythropoietin production in a cell or organism. Thus, methods and compositions including these iRNAs are useful for treating pathological processes that can be mediated by down regulating EGLN genes or those which are associated with low EPO levels. The following detailed description discloses how to make and use compositions containing iRNAs to inhibit the expression of one or more EGLN genes, as well as compositions and methods for treating diseases and disorders caused by or modulated by the expression of this gene. Embodiments of the pharmaceutical compositions featured in the invention include an iRNA having an antisense strand comprising a region which is 30 nucleotides or less in length, generally 19-24 nucleotides in length, which region is substantially complementary to at least part of an RNA transcript of an EGLN gene, together with a pharmaceutically acceptable carrier. Embodiments of compositions featured in the invention also include an iRNA having an antisense strand having a region of complementarity which is 30 nucleotides or less in length, generally 19-24 nucleotides in length, and is substantially complementary to at least part of an RNA transcript of an EGLN gene.

Accordingly, in some aspects, pharmaceutical compositions containing one or more EGLN iRNA agents and a pharmaceutically acceptable carrier, methods of using the compositions to inhibit expression of an EGLN gene, and methods of using the pharmaceutical compositions to treat diseases caused by expression of an EGLN gene are featured in the invention.

I. Definitions

For convenience, the meaning of certain terms and phrases used in the specification, examples, and appended claims, are provided below. If there is an apparent discrepancy between the usage of a term in other parts of this specification and its definition provided in this section, the definition in this section shall prevail.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

As used herein, "EGLN" ("EGL Nine Homolog") refers to any one or all of the group of EGLN genes. In the mouse, these genes are known as EGLN1 (PHD2, prolyl hydroxylase domain-containing protein 2 and by the synonyms hif-prolyl hydroxylase 2; hifph2; hph2; chromosome 1 open reading frame 12; clorf12; sm20, rat, homolog of; sm20; zinc finger mynd domain-containing protein 6; and zmynd6), EGLN2 (PHD1, prolyl hydroxylase domain-containing protein 1; and by the synonyms hif-prolyl hydroxylase 1; hifph1) and EGLN3 (PHD3 prolyl hydroxylase domain-containing protein 3; and by the synonyms hif-prolyl hydroxylase 3; hifph3). The sequences of the mouse EGLN mRNA transcripts can be found at NM_053207.2 (EGLN1; SEQ ID NO: 5), NM_053208.4 (EGLN2; SEQ ID NO: 6) and NM_028133.2 (EGLN3; SEQ ID NO: 7). The sequence of a human EGLN mRNA transcripts can be found at NM_022051.2 (EGLN1); NM_053046.2 (EGLN2) and NM_022073.3 (EGLN3).

As used herein, the term "iRNA" refers to an agent that contains RNA as that term is defined herein, and which mediates the targeted cleavage of an RNA transcript via an RNA-induced silencing complex (RISC) pathway. In one embodiment, an iRNA as described herein effects inhibition of EGLN expression. Alternatively, in another embodiment, an iRNA as described herein activates EGLN expression.

As used herein, the term "iRNA mix" or "iRNA cocktail" refers to a composition that comprises more than one iRNA. The iRNA mixes or cocktails of the present invention may comprise one or more iRNA agents to a single EGLN gene or may comprise one or more iRNA agents targeted to more than one EGLN gene. Where an iRNA mix or cocktail contains only iRNA agents targeting one or more EGLN genes, this mix may be referred to as an "EGLN mix" or "EGLN cocktail."

As used herein, "target sequence" refers to a contiguous portion of the nucleotide sequence of an mRNA molecule formed during the transcription of an EGLN gene, including mRNA that is a product of RNA processing of a primary transcription product. The target portion of the sequence will be at least long enough to serve as a substrate for iRNA-directed cleavage at or near that portion. For example, the target sequence will generally be from 9-36 nucleotides in length, e.g., 15-30 nucleotides in length, including all subranges therebetween. As non-limiting examples, the target sequence can be from 15-30 nucleotides, 15-26 nucleotides, 15-23 nucleotides, 15-22 nucleotides, 15-21 nucleotides, 15-20 nucleotides, 15-19 nucleotides, 15-18 nucleotides, 15-17 nucleotides, 18-30 nucleotides, 18-26 nucleotides, 18-23 nucleotides, 18-22 nucleotides, 18-21 nucleotides, 18-20 nucleotides, 19-30 nucleotides, 19-26 nucleotides, 19-23 nucleotides, 19-22 nucleotides, 19-21 nucleotides, 19-20 nucleotides, 20-30 nucleotides, 20-26 nucleotides, 20-25 nucleotides, 20-24 nucleotides, 20-23 nucleotides, 20-22 nucleotides, 20-21 nucleotides, 21-30 nucleotides, 21-26 nucleotides, 21-25 nucleotides, 21-24 nucleotides, 21-23 nucleotides, or 21-22 nucleotides.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they may form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes described herein.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but are not limited to, G:U Wobble or Hoogstein base pairing.

The terms "complementary," "fully complementary" and "substantially complementary" herein may be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding an EGLN protein). For example, a polynucleotide is complementary to at least a part of an EGLN mRNA if the sequence is substantially complementary to a non-interrupted portion of an mRNA encoding EGLN.

The term "double-stranded RNA" or "dsRNA," as used herein, refers to an iRNA that includes an RNA molecule or complex of molecules having a hybridized duplex region that comprises two anti-parallel and substantially complementary nucleic acid strands, which will be referred to as having "sense" and "antisense" orientations with respect to a target RNA. The duplex region can be of any length that permits specific degradation of a desired target RNA through a RISC pathway, but will typically range from 9 to 36 base pairs in length, e.g., 15-30 base pairs in length. Considering a duplex between 9 and 36 base pairs, the duplex can be any length in this range, for example, 9, 10, 11, 12, 13, 14, 15, 16, 17, 18, 19, 20, 21, 22, 23, 24, 25, 26, 27, 28, 29, 30, 31, 32, 33, 34, 35, or 36 and any sub-range therein between, including, but not limited to 15-30 base pairs, 15-26 base pairs, 15-23 base pairs, 15-22 base pairs, 15-21 base pairs, 15-20 base pairs, 15-19 base pairs, 15-18 base pairs, 15-17 base pairs, 18-30 base pairs, 18-26 base pairs, 18-23 base pairs, 18-22 base pairs, 18-21 base pairs, 18-20 base pairs, 19-30 base pairs, 19-26 base pairs, 19-23 base pairs, 19-22 base pairs, 19-21 base pairs, 19-20 base pairs, 20-30 base pairs, 20-26 base pairs, 20-25 base pairs, 20-24 base pairs, 20-23 base pairs, 20-22 base pairs, 20-21 base pairs, 21-30 base pairs, 21-26 base pairs, 21-25 base pairs, 21-24 base pairs, 21-23 base pairs, or 21-22 base pairs. dsRNAs generated in the cell by processing with Dicer and similar enzymes are generally in the range of 19-22 base pairs in length. One strand of the duplex region of a dsDNA comprises a sequence that is substantially complementary to a region of a target RNA. The two strands forming the duplex structure can be from a single RNA molecule having at least one self-complementary region, or can be formed from two or more separate RNA molecules. Where the duplex region is formed from two strands of a single molecule, the molecule can have a duplex region separated by a single stranded chain of nucleotides (herein referred to as a "hairpin loop") between the 3'-end of one strand and the 5'-end of the respective other strand forming the duplex structure. The hairpin loop can comprise at least one unpaired nucleotide; in some embodiments the hairpin loop can comprise at least 3, at least 4, at least 5, at least 6, at least 7, at least 8, at least 9, at least 10, at least 20, at least 23 or more unpaired nucleotides. Where the two substantially complementary strands of a dsRNA are comprised by separate RNA molecules, those molecules need not, but can be covalently connected. Where the two strands are connected covalently by means other than a hairpin loop, the connecting structure is referred to as a "linker." The term "siRNA" is also used herein to refer to a dsRNA as described above.

The skilled artisan will recognize that the term "RNA molecule" or "ribonucleic acid molecule" encompasses not only RNA molecules as expressed or found in nature, but also analogs and derivatives of RNA comprising one or more ribonucleotide/ribonucleoside analogs or derivatives as described herein or as known in the art. Strictly speaking, a "ribonucleoside" includes a nucleoside base and a ribose sugar, and a "ribonucleotide" is a ribonucleoside with one, two or three phosphate moieties. However, the terms "ribonucleoside" and "ribonucleotide" can be considered to be equivalent as used herein. The RNA can be modified in the nucleobase structure or in the ribose-phosphate backbone structure, e.g., as described herein below. However, the molecules comprising ribonucleoside analogs or derivatives must retain the ability to form a duplex. As non-limiting examples, an RNA molecule can also include at least one modified ribonucleoside including but not limited to a 2'-O-methyl modified nucleotide, a nucleoside comprising a 5' phosphorothioate group, a terminal nucleoside linked to a cholesteryl derivative or dodecanoic acid bisdecylamide group, a locked nucleoside, an abasic nucleoside, a 2'-deoxy-2'-fluoro modified nucleoside, a 2'-amino-modified nucleoside, 2'-alkyl-modified nucleoside, morpholino nucleoside, a phosphoramidate or a non-natural base comprising nucleoside, or any combination thereof. Alternatively, an RNA molecule can comprise at least two modified ribonucleosides, at least 3, at least 4, at least 5, at least 6, at least 7, at least 8, at least 9, at least 10, at least 15, at least 20 or more, up to the entire length of the dsRNA molecule. The modifications need not be the same for each of such a plurality of modified ribonucleosides in an RNA molecule. In one embodiment, modified RNAs contemplated for use in methods and compositions described herein are peptide nucleic acids (PNAs) that have the ability to form the required duplex structure and that permit or mediate the specific degradation of a target RNA via a RISC pathway.

In one aspect, a modified ribonucleoside includes a deoxyribonucleoside. In such an instance, an iRNA agent can comprise one or more deoxynucleosides, including, for example, a deoxynucleoside overhang(s), or one or more deoxynucleosides within the double stranded portion of a dsRNA. However, it is self evident that under no circumstances is a double stranded DNA molecule encompassed by the term "iRNA."

In one aspect, an RNA interference agent includes a single stranded RNA that interacts with a target RNA sequence to direct the cleavage of the target RNA. Without wishing to be bound by theory, long double stranded RNA introduced into plants and invertebrate cells is broken down into siRNA by a Type III endonuclease known as Dicer (Sharp et al., Genes Dev. 2001, 15:485). Dicer, a ribonuclease-III-like enzyme, processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) Cell 107:309). Upon binding to the appropriate target mRNA, one or more endonucleases within the RISC cleaves the target to induce silencing (Elbashir, et al., (2001) Genes Dev. 15:188). Thus, in one aspect the invention relates to a single stranded RNA that promotes the formation of a RISC complex to effect silencing of the target gene.

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) may be on the sense strand, the antisense strand or any combination thereof. Furthermore, the nucleotide(s) of an overhang can be present on the 5' end, 3' end or both ends of either an antisense or sense strand of a dsRNA.

In one embodiment, the antisense strand of a dsRNA has a 1-10 nucleotide overhang at the 3' end and/or the 5' end. In one embodiment, the sense strand of a dsRNA has a 1-10 nucleotide overhang at the 3' end and/or the 5' end. In another embodiment, one or more of the nucleotides in the overhang is replaced with a nucleoside thiophosphate.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double-stranded over its entire length.

The term "antisense strand" or "guide strand" refers to the strand of an iRNA, e.g., a dsRNA, which includes a region that is substantially complementary to a target sequence. As used herein, the term "region of complementarity" refers to the region on the antisense strand that is substantially complementary to a sequence, for example a target sequence, as defined herein. Where the region of complementarity is not fully complementary to the target sequence, the mismatches may be in the internal or terminal regions of the molecule. Generally, the most tolerated mismatches are in the terminal regions, e.g., within 5, 4, 3, or 2 nucleotides of the 5' and/or 3' terminus.

The term "sense strand" or "passenger strand" as used herein, refers to the strand of an iRNA that includes a region that is substantially complementary to a region of the antisense strand as that term is defined herein.

As used herein, the term "SNALP" refers to a stable nucleic acid-lipid particle. A SNALP represents a vesicle of lipids coating a reduced aqueous interior comprising a nucleic acid such as an iRNA or a plasmid from which an iRNA is transcribed. SNALPs are described, e.g., in U.S. Patent Application Publication Nos. 20060240093, 20070135372, and in International Application No. WO 2009082817. These applications are incorporated herein by reference in their entirety.

"Introducing into a cell," when referring to an iRNA, means facilitating or effecting uptake or absorption into the cell, as is understood by those skilled in the art. Absorption or uptake of an iRNA can occur through unaided diffusive or active cellular processes, or by auxiliary agents or devices. The meaning of this term is not limited to cells in vitro; an iRNA may also be "introduced into a cell," wherein the cell is part of a living organism. In such an instance, introduction into the cell will include the delivery to the organism. For example, for in vivo delivery, iRNA can be injected into a tissue site or administered systemically. In vivo delivery can also be by a beta-glucan delivery system, such as those described in U.S. Pat. Nos. 5,032,401 and 5,607,677, and U.S. Publication No. 2005/0281781, which are hereby incorporated by reference in their entirety. In vitro introduction into a cell includes methods known in the art such as electroporation and lipofection. Further approaches are described herein below or known in the art.

As used herein, the term "modulate the expression of," refers to at an least partial "inhibition" or partial "activation" of one or more EGLN gene expression in a cell treated with an iRNA composition as described herein compared to the expression of the one or more EGLN genes in an untreated cell.

The terms "activate," "enhance," "up-regulate the expression of," "increase the expression of," and the like, in so far as they refer to an EGLN gene, herein refer to the at least partial activation of the expression of an EGLN gene, as manifested by an increase in the amount of EGLN mRNA, which may be isolated from or detected in a first cell or group of cells in which an EGLN gene is transcribed and which has or have been treated such that the expression of an EGLN gene is increased, as compared to a second cell or group of cells substantially identical to the first cell or group of cells but which has or have not been so treated (control cells).

In one embodiment, expression of an EGLN gene is activated by at least about 10%, 15%, 20%, 25%, 30%, 35%, 40%, 45%, or 50% by administration of an iRNA as described herein. In some embodiments, an EGLN gene is activated by at least about 60%, 70%, or 80% by administration of an iRNA featured in the invention. In some embodiments, expression of an EGLN gene is activated by at least about 85%, 90%, or 95% or more by administration of an iRNA as described herein. In some embodiments, EGLN gene expression is increased by at least 1-fold, at least 2-fold, at least 5-fold, at least 10-fold, at least 50-fold, at least 100-fold, at least 500-fold, at least 1000 fold or more in cells treated with an iRNA as described herein compared to the expression in an untreated cell. Activation of expression by small dsRNAs is described, for example, in Li et al., 2006 *Proc. Natl. Acad. Sci. U.S.A.* 103:17337-42, and in US20070111963 and US2005226848, each of which is incorporated herein by reference.

The terms "silence," "inhibit the expression of," "down-regulate the expression of," "suppress the expression of," and the like, in so far as they refer to an EGLN gene, herein refer to the at least partial suppression of the expression of an EGLN gene, as manifested by a reduction of the amount of EGLN mRNA which may be isolated from or detected in a first cell or group of cells in which an EGLN gene is transcribed and which has or have been treated such that the expression of an EGLN gene is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\%$$

Alternatively, the degree of inhibition may be given in terms of a reduction of a parameter that is functionally linked to EGLN gene expression, e.g., the amount of protein encoded by an EGLN gene, or the number of cells displaying a certain phenotype, e.g., lack of or decreased cytokine production. In principle, EGLN gene silencing may be determined in any cell expressing EGLN, either constitutively or by genomic engineering, and by any appropriate assay. However, when a reference is needed in order to determine whether a given iRNA inhibits the expression of an EGLN gene by a certain degree and therefore is encompassed by the instant invention, the assays provided in the Examples below shall serve as such reference.

For example, in certain instances, expression of an EGLN gene is suppressed by at least about 10%, 15%, 20%, 25%, 30%, 35%, 40%, 45%, or 50% by administration of an iRNA featured in the invention. In some embodiments, an EGLN gene is suppressed by at least about 60%, 70%, or 80% by administration of an iRNA featured in the invention. In some embodiments, an EGLN gene is suppressed by at least about 85%, 90%, 95%, 98%, 99%, or more by administration of an iRNA as described herein.

As used herein in the context of EGLN expression, the terms "treat," "treatment," and the like, refer to relief from or alleviation of pathological processes mediated by EGLN expression. In the context of the present invention insofar as it relates to any of the other conditions recited herein below (other than pathological processes mediated by EGLN expression), the terms "treat," "treatment," and the like mean to relieve or alleviate at least one symptom associated with such condition, or to slow or reverse the progression or anticipated progression of such condition, such as slowing the progression of a malignancy or cancer, treating anemia, hypoxia, neurological conditions including degeneration, renal disease or failure, and cancers including those of the blood, bone and marrow.

By "lower" in the context of a disease marker or symptom is meant a statistically significant decrease in such level. The decrease can be, for example, at least 10%, at least 20%, at least 30%, at least 40% or more, and is preferably down to a level accepted as within the range of normal for an individual without such disorder.

As used herein, the phrases "therapeutically effective amount" and "prophylactically effective amount" refer to an amount that provides a therapeutic benefit in the treatment, prevention, or management of pathological processes mediated by EGLN expression or an overt symptom of pathological processes mediated by EGLN expression. In one embodiment, a therapeutically effective amount is that amount of iRNA agent or agents which result in the increased production of erythropoietin in the system being treated. The specific amount that is therapeutically effective can be readily determined by an ordinary medical practitioner, and may vary depending on factors known in the art, such as, for example, the type of pathological processes mediated by EGLN expression, the patient's history and age, the stage of pathological processes mediated by EGLN expression, and the administration of other agents that inhibit pathological processes mediated by EGLN expression.

As used herein, a "pharmaceutical composition" comprises a pharmacologically effective amount of an iRNA and a pharmaceutically acceptable carrier. As used herein, "pharmacologically effective amount," "therapeutically effective amount" or simply "effective amount" refers to that amount of an iRNA effective to produce the intended pharmacological, therapeutic or preventive result. For example, if a given clinical treatment is considered effective when there is at least a 10% reduction in a measurable parameter associated with a disease or disorder, a therapeutically effective amount of a drug for the treatment of that disease or disorder is the amount necessary to effect at least a 10% reduction in that parameter. For example, a therapeutically effective amount of an iRNA targeting EGLN can reduce EGLN protein levels by at least 10% or may result in the increase in EPO production by at least 1%, 5%, 10% or more.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. Agents included in drug formulations are described further herein below.

II. Double-Stranded Ribonucleic Acid (dsRNA)

Described herein are iRNA agents that inhibit the expression of one or more EGLN genes. In one embodiment, the iRNA agent includes double-stranded ribonucleic acid (dsRNA) molecules for inhibiting the expression of an EGLN gene in a cell or mammal, e.g., in a human having anemia, hypoxia, neurological conditions including degeneration, renal disease or failure, or cancers including those of the blood, bone and marrow where the dsRNA includes an antisense strand having a region of complementarity which is complementary to at least a part of an mRNA formed in the expression of an EGLN gene, and where the region of complementarity is 30 nucleotides or less in length, generally 19-24 nucleotides in length, and where the dsRNA, upon contact with a cell expressing the EGLN gene, inhibits the expression of the EGLN gene by at least 10% as assayed by, for example, a PCR or branched DNA (bDNA)-based method, or by a protein-based method, such as by Western blot. In one embodiment, the iRNA agent activates the expression of an EGLN gene in a cell or mammal. Expression of an EGLN gene in cell culture, such as in COS cells, HeLa cells, primary hepatocytes, kidney cells, HEK-293 cells, MDCK cells, HepG2 cells, primary cultured cells or in a biological sample from a subject can be assayed by measuring EGLN mRNA levels, such as by bDNA or TaqMan assay, or by measuring protein levels, such as by immunofluorescence analysis, using, for example, Western Blotting or flowcytometric techniques.

A dsRNA includes two RNA strands that are sufficiently complementary to hybridize to form a duplex structure under conditions in which the dsRNA will be used. One strand of a dsRNA (the antisense strand) includes a region of complementarity that is substantially complementary, and generally fully complementary, to a target sequence, derived from the sequence of an mRNA formed during the expression of an EGLN gene. The other strand (the sense strand) includes a region that is complementary to the antisense strand, such that the two strands hybridize and form a duplex structure when combined under suitable conditions. Generally, the duplex structure is between 15 and 30 inclusive, more generally between 18 and 25 inclusive, yet more generally between 19 and 24 inclusive, and most generally between 19 and 21 base pairs in length, inclusive. Similarly, the region of complementarity to the target sequence is between 15 and 30 inclusive, more generally between 18 and 25 inclusive, yet more generally between 19 and 24 inclusive, and most generally between 19 and 21 nucleotides in length, inclusive. In some embodiments, the dsRNA is between 15 and 20 nucleotides in length, inclusive, and in other embodiments, the dsRNA is between 25 and 30 nucleotides in length, inclusive. As the ordinarily skilled person will recognize, the targeted region of an RNA targeted for cleavage will most often be part of a larger RNA molecule, often an mRNA molecule. Where relevant, a "part" of an mRNA target is a contiguous sequence of an mRNA target of sufficient length to be a substrate for RNAi-directed cleavage (i.e., cleavage through a RISC pathway). dsRNAs having duplexes as short as 9 base pairs can, under some circumstances, mediate RNAi-directed RNA cleavage. Most often a target will be at least 15 nucleotides in length, preferably 15-30 nucleotides in length.

One of skill in the art will also recognize that the duplex region is a primary functional portion of a dsRNA, e.g., a duplex region of 9 to 36, e.g., 15-30 base pairs. Thus, in one embodiment, to the extent that it becomes processed to a functional duplex of e.g., 15-30 base pairs that targets a desired RNA for cleavage, an RNA molecule or complex of RNA molecules having a duplex region greater than 30 base pairs is a dsRNA. Thus, an ordinarily skilled artisan will recognize that in one embodiment, then, a miRNA is a dsRNA. In another embodiment, a dsRNA is not a naturally occurring miRNA. In another embodiment, an iRNA agent useful to target EGLN expression is not generated in the target cell by cleavage of a larger dsRNA.

A dsRNA as described herein may further include one or more single-stranded nucleotide overhangs. The dsRNA can be synthesized by standard methods known in the art as further discussed below, e.g., by use of an automated DNA synthesizer, such as are commercially available from, for example, Biosearch, Applied Biosystems, Inc. In one embodiment, an EGLN gene is a human EGLN gene. In another embodiment the EGLN gene is a mouse or a rat EGLN gene. In specific embodiments, the first sequence is a sense strand of a dsRNA that includes a sense sequence from Tables 2A-F and 6A-C, and the second sequence is selected from the group consisting of the corresponding antisense sequences of Tables 2A-F and 6A-C. Alternative dsRNA agents that target elsewhere in the target sequence provided in Tables 2A-F and 6A-C can readily be determined using the target sequence and the flanking EGLN sequence.

In one aspect, a dsRNA will include at least nucleotide sequences, whereby the sense strand is selected from the groups of sequences provided in Tables 2A-F and 6A-C, and the corresponding antisense strand of the sense strand selected from Tables 2A-F and 6A-C. In this aspect, one of the two sequences is complementary to the other of the two sequences, with one of the sequences being substantially complementary to a sequence of an mRNA generated in the expression of an EGLN gene. As such, in this aspect, a dsRNA will include two oligonucleotides, where one oligonucleotide is described as the sense strand in Tables 2A-F and 6A-C, and the second oligonucleotide is described as the corresponding antisense strand of the sense strand from Tables 2A-F and 6A-C. As described elsewhere herein and as known in the art, the complementary sequences of a dsRNA can also be contained as self-complementary regions of a single nucleic acid molecule, as opposed to being on separate oligonucleotides.

The skilled person is well aware that dsRNAs having a duplex structure of between 20 and 23, but specifically 21, base pairs have been hailed as particularly effective in inducing RNA interference (Elbashir et al., EMBO 2001, 20:6877-6888). However, others have found that shorter or longer RNA duplex structures can be effective as well. In the embodiments described above, by virtue of the nature of the oligonucleotide sequences provided in Tables 2A-F and 6A-C, dsRNAs described herein can include at least one strand of a length of minimally 21 nt. It can be reasonably expected that shorter duplexes having one of the sequences of Tables 2A-F and 6A-C minus only a few nucleotides on one or both ends may be similarly effective as compared to the dsRNAs described above. Hence, dsRNAs having a partial sequence of at least 15, 16, 17, 18, 19, 20, or more contiguous nucleotides from one of the sequences of Tables 2A-F and 6A-C, and differing in their ability to inhibit the expression of an EGLN gene by not more than 5, 10, 15, 20, 25, or 30% inhibition from a dsRNA comprising the full sequence, are contemplated according to the invention.

In addition, the RNAs provided in Tables 2A-F and 6A-C identify a site in an EGLN transcript that is susceptible to RISC-mediated cleavage. As such, the present invention further features iRNAs that target within one of such sequences. As used herein, an iRNA is said to target within a particular site of an RNA transcript if the iRNA promotes cleavage of the transcript anywhere within that particular site. Such an iRNA will generally include at least 15 contiguous nucleotides from one of the sequences provided in Tables 2A-F and 6A-C coupled to additional nucleotide sequences taken from the region contiguous to the selected sequence in an EGLN gene.

While a target sequence is generally 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that may serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with an iRNA agent, mediate the best inhibition of target gene expression. Thus, while the sequences identified, for example, in Tables 2A-F and 6A-C represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified, e.g., in Tables 2A-F and 6A-C, further optimization could be achieved by systematically either adding or removing nucleotides to generate longer or shorter sequences and testing those and sequences generated by walking a window of the longer or shorter size up or down the target RNA from that point. Again, coupling this approach to generating new candidate targets with testing for effectiveness of iRNAs based on those target sequences in an inhibition assay as known in the art or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes, etc.) as an expression inhibitor.

An iRNA as described herein can contain one or more mismatches to the target sequence. In one embodiment, an iRNA as described herein contains no more than 3 mismatches. If the antisense strand of the iRNA contains mismatches to a target sequence, it is preferable that the area of mismatch not be located in the center of the region of complementarity. If the antisense strand of the iRNA contains mismatches to the target sequence, it is preferable that the mismatch be restricted to be within the last 5 nucleotides from either the 5' or 3' end of the region of complementarity. For example, for a 23 nucleotide iRNA agent RNA strand which is complementary to a region of an EGLN gene, the RNA strand generally does not contain any mismatch within the central 13 nucleotides. The methods described herein or methods known in the art can be used to determine whether an iRNA containing a mismatch to a target sequence is effective in inhibiting the expression of an EGLN gene. Consideration of the efficacy of iRNAs with mismatches in inhibiting expression of an EGLN gene is important, especially if the particular region of complementarity in an EGLN gene is known to have polymorphic sequence variation within the population.

In one embodiment, at least one end of a dsRNA has a single-stranded nucleotide overhang of 1 to 4, generally 1 or 2 nucleotides. dsRNAs having at least one nucleotide overhang have unexpectedly superior inhibitory properties relative to their blunt-ended counterparts. In yet another embodiment, the RNA of an iRNA, e.g., a dsRNA, is chemically modified to enhance stability or other beneficial characteristics. The nucleic acids featured in the invention may be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, (a) end modifications, e.g., 5' end modifications (phosphorylation, conjugation, inverted linkages, etc.) 3' end modifications (conjugation, DNA nucleotides, inverted linkages, etc.), (b) base modifications, e.g., replacement with stabilizing bases, destabilizing bases, or bases that base pair with an expanded repertoire of partners, removal of bases (abasic nucleotides), or conjugated bases, (c) sugar modifications (e.g., at the 2' position or 4' position) or replacement of the sugar, as well as (d) backbone modifications, including modification or replacement of the phosphodiester linkages. Specific examples of RNA compounds useful in this invention include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In particular embodiments, the modified RNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, each of which is herein incorporated by reference Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, each of which is herein incorporated by reference.

In other RNA mimetics suitable or contemplated for use in iRNAs, both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found, for example, in Nielsen et al., Science, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$—[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$—[wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs may also contain one or more substituted sugar moieties. The iRNAs, e.g., dsRNAs, featured herein can include one of the following at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., Helv. Chim. Acta, 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_2$)$_2$, also described in examples herein below.

Other modifications include 2'-methoxy (2'-$OCH_3$), 2'-aminopropoxy (2'-$OCH_2CH_2CH_2NH_2$) and 2'-fluoro (2'-F). Similar modifications may also be made at other positions on the RNA of an iRNA, particularly the 3' position of the sugar on the 3' terminal nucleotide or in 2'-5' linked dsRNAs and the 5' position of 5' terminal nucleotide. iRNAs may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference.

An iRNA may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. I., ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 6,015,886; 6,147,200; 6,166,197; 6,222,025; 6,235,887; 6,380,368; 6,528,640; 6,639,062; 6,617,438; 7,045,610; 7,427,672; and 7,495,088, each of which is herein incorporated by reference, and U.S. Pat. No. 5,750,692, also herein incorporated by reference.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc. Ther* 6(3):833-843; Grunweller, A. et al., (2003) *Nucleic Acids Research* 31(12):3185-3193).

Representative U.S. Patents that teach the preparation of locked nucleic acid nucleotides include, but are not limited to, the following: U.S. Pat. Nos. 6,268,490; 6,670,461; 6,794,499; 6,998,484; 7,053,207; 7,084,125; and 7,399,845, each of which is herein incorporated by reference in its entirety.

Another modification of the RNA of an iRNA featured in the invention involves chemically linking to the RNA one or more ligands, moieties or conjugates that enhance the activity, cellular distribution or cellular uptake of the iRNA. Such moieties include but are not limited to lipid moieties such as a cholesterol moiety (Letsinger et al., Proc. Natl. Acid. Sci. USA, 1989, 86: 6553-6556), cholic acid (Manoharan et al., Biorg. Med. Chem. Let., 1994, 4:1053-1060), a thioether, e.g., beryl-S-tritylthiol (Manoharan et al., Ann. N.Y. Acad. Sci., 1992, 660:306-309; Manoharan et al., Biorg. Med. Chem. Let., 1993, 3:2765-2770), a thiocholesterol (Oberhauser et al., Nucl. Acids Res., 1992, 20:533-538), an aliphatic chain, e.g., dodecandiol or undecyl residues (Saison-Behmoaras et al., EMBO J, 1991, 10:1111-1118; Kabanov et al., FEBS Lett., 1990, 259:327-330; Svinarchuk et al., Biochimie, 1993, 75:49-54), a phospholipid, e.g., di-hexadecyl-rac-glycerol or triethylammonium 1,2-di-O-hexadecyl-rac-glycero-3-phosphonate (Manoharan et al., Tetrahedron Lett., 1995, 36:3651-3654; Shea et al., Nucl. Acids Res., 1990, 18:3777-3783), a polyamine or a polyethylene glycol chain (Manoharan et al., Nucleosides & Nucleotides, 1995, 14:969-973), or adamantane acetic acid (Manoharan et al., Tetrahedron Lett., 1995, 36:3651-3654), a palmityl moiety (Mishra et al., Biochim. Biophys. Acta, 1995, 1264:229-237), or an octadecylamine or hexylaminocarbonyloxycholesterol moiety (Crooke et al., J. Pharmacol. Exp. Ther., 1996, 277:923-937).

In one embodiment, a ligand alters the distribution, targeting or lifetime of an iRNA agent into which it is incorporated. In preferred embodiments a ligand provides an enhanced affinity for a selected target, e.g, molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, or an RGD peptide or RGD peptide mimetic.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g, cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In one ligand, the ligand is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to modulate, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by cancer cells. Also included are HSA and low density lipoprotein (LDL).

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO:1). An RFGF analogue (e.g., amino acid sequence AALLPVL-LAAP (SEQ ID NO:2)) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO:3)) and the *Drosophila Antennapedia* protein (RQIKIWFQNRRMK-WKK (SEQ ID NO: 4)) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Preferably the peptide or peptidomimetic tethered to a dsRNA agent via an incorporated monomer unit is a cell targeting peptide such as an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide moiety can be used to target a tumor cell, such as an endothelial tumor cell or a breast cancer tumor cell (Zitzmann et al., Cancer Res., 62:5139-43, 2002). An RGD peptide can facilitate targeting of an dsRNA agent to tumors of a variety of other tissues, including the lung, kidney, spleen, or liver (Aoki et al., Cancer Gene Therapy 8:783-787, 2001). Preferably, the RGD peptide will facilitate targeting of an iRNA agent to the kidney. The RGD peptide can be linear or cyclic, and can be modified, e.g., glycosylated or methylated to facilitate targeting to specific tissues. For example, a glycosylated RGD peptide can deliver a iRNA agent to a tumor cell expressing $\alpha v \beta_3$ (Haubner et al., Jour. Nucl. Med., 42:326-336, 2001).

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; each of which is herein incorporated by reference.

It is not necessary for all positions in a given compound to be uniformly modified, and in fact more than one of the aforementioned modifications may be incorporated in a single compound or even at a single nucleoside within an iRNA. The present invention also includes iRNA compounds that are chimeric compounds. "Chimeric" iRNA compounds or "chimeras," in the context of this invention, are iRNA compounds, preferably dsRNAs, which contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., Biochem. Biophys. Res. Comm., 2007, 365(1):54-61; Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-S-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction may be performed either with the RNA still bound to the solid support or following cleavage of the RNA, in solution phase. Purification of the RNA conjugate by HPLC typically affords the pure conjugate.

Delivery of iRNA

The delivery of one or more iRNA to a subject in need thereof can be achieved in a number of different ways. In vivo delivery can be performed directly by administering a composition comprising an iRNA, e.g. a dsRNA, to a subject. Alternatively, delivery can be performed indirectly by administering one or more vectors that encode and direct the expression of the iRNA. These alternatives are discussed further below.

Direct Delivery

In general, any method of delivering a nucleic acid molecule can be adapted for use with an iRNA (see e.g., Akhtar S. and Julian R L. (1992) Trends Cell. Biol. 2(5): 139-144 and WO94/02595, which are incorporated herein by reference in their entireties). However, there are three factors that are important to consider in order to successfully deliver an iRNA molecule in vivo: (a) biological stability of the delivered molecule, (2) preventing non-specific effects, and (3) accumulation of the delivered molecule in the target tissue. The non-specific effects of an iRNA can be minimized by local administration, for example by direct injection or implantation into a tissue (as a non-limiting example, a tumor) or topically administering the preparation. Local administration to a treatment site maximizes local concentration of the agent, limits the exposure of the agent to systemic tissues that may otherwise be harmed by the agent or that may degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J., et al (2004) Retina 24:132-138) and subretinal injections in mice (Reich, S J., et al (2003) Mol. Vis. 9:210-216) were both shown to prevent neovascularization in an experimental model of age-related macular degeneration. In addition, direct intratumoral injection of a dsRNA in mice reduces tumor volume (Pille, J., et al (2005) Mol. Ther. 11:267-274) and can prolong survival of tumor-bearing mice (Kim, W J., et al (2006) Mol. Ther. 14:343-350; Li, S., et al (2007) Mol. Ther. 15:515-523). RNA interference has also shown success with local delivery to the CNS by direct injection (Dorn, G., et al. (2004) Nucleic Acids 32:e49; Tan, P H., et al (2005) Gene Ther. 12:59-66; Makimura, H., et al (2002) BMC Neurosci. 3:18;

Shishkina, G T., et al (2004) Neuroscience 129:521-528; Thakker, E R., et al (2004) Proc. Natl. Acad. Sci. U.S.A. 101:17270-17275; Akaneya, Y., et al (2005) J. Neurophysiol. 93:594-602) and to the lungs by intranasal administration (Howard, K A., et al (2006) Mol. Ther. 14:476-484; Zhang, X., et al (2004) J. Biol. Chem. 279:10677-10684; Bitko, V., et al (2005) Nat. Med. 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA composition to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) Nature 432:173-178). Conjugation of an iRNA to an aptamer has been shown to inhibit tumor growth and mediate tumor regression in a mouse model of prostate cancer (McNamara, J O., et al (2006) Nat. Biotechnol. 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H., et al (2008) Journal of Controlled Release 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al (2003) J. Mol. Biol 327:761-766; Verma, U N., et al (2003) Clin. Cancer Res. 9:1291-1300; Arnold, A S et al (2007) J. Hypertens. 25:197-205, which are incorporated herein by reference in their entirety). Some non-limiting examples of drug delivery systems useful for systemic delivery of iRNAs include DOTAP (Sorensen, D R., et al (2003), supra; Verma, U N., et al (2003), supra), Oligofectamine, "solid nucleic acid lipid particles" (Zimmermann, T S., et al (2006) Nature 441:111-114), cardiolipin (Chien, P Y., et al (2005) Cancer Gene Ther. 12:321-328; Pal, A., et al (2005) Int J. Oncol. 26:1087-1091), polyethyleneimine (Bonnet M E., et al (2008) Pharm. Res. August 16 Epub ahead of print; Aigner, A. (2006) J. Biomed. Biotechnol. 71659), Arg-Gly-Asp (RGD) peptides (Liu, S. (2006) Mol. Pharm. 3:472-487), and polyamidoamines (Tomalia, D A., et al (2007) Biochem. Soc. Trans. 35:61-67; Yoo, H., et al (1999) Pharm. Res. 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

Vector Encoded dsRNAs

In another aspect, iRNA targeting one or more of the EGLN genes can be expressed from transcription units inserted into DNA or RNA vectors (see, e.g., Couture, A, et al., TIG. (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., Proc. Natl. Acad. Sci. USA (1995) 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as an inverted repeat joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

iRNA expression plasmids can be transfected into target cells as a complex with cationic lipid carriers (e.g., Oligofectamine) or non-cationic lipid-based carriers (e.g., Transit-TKO™). Multiple lipid transfections for iRNA-mediated knockdowns targeting different regions of a target RNA over a period of a week or more are also contemplated by the invention. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct may be incorporated into vectors capable of episomal replication, e.g EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are further described below.

Vectors useful for the delivery of an iRNA will include regulatory elements (promoter, enhancer, etc.) sufficient for expression of the iRNA in the desired target cell or tissue. The regulatory elements can be chosen to provide either constitutive or regulated/inducible expression.

Expression of the iRNA can be precisely regulated, for example, by using an inducible regulatory sequence that is sensitive to certain physiological regulators, e.g., circulating glucose levels, or hormones (Docherty et al., 1994, FASEB J. 8:20-24). Such inducible expression systems, suitable for the control of dsRNA expression in cells or in mammals include, for example, regulation by ecdysone, by estrogen, progesterone, tetracycline, chemical inducers of dimerization, and isopropyl-beta-D1-thiogalactopyranoside (IPTG). A person skilled in the art would be able to choose the appropriate regulatory/promoter sequence based on the intended use of the iRNA transgene.

In a specific embodiment, viral vectors that contain nucleic acid sequences encoding an iRNA can be used. For example, a retroviral vector can be used (see Miller et al., Meth. Enzymol. 217:581-599 (1993)). These retroviral vectors contain the components necessary for the correct packaging of the viral genome and integration into the host cell DNA. The nucleic acid sequences encoding an iRNA are cloned into one or more vectors, which facilitates delivery of the nucleic acid into a patient. More detail about retroviral vectors can be found, for example, in Boesen et al., Biotherapy 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., J. Clin. Invest. 93:644-651 (1994); Kiem et al., Blood 83:1467-1473 (1994); Salmons and Gunzberg, Human Gene Therapy 4:129-141 (1993); and Grossman and Wilson, Curr. Opin. in Genetics and Devel. 3:110-114 (1993). Lentiviral vectors contemplated for use include, for example, the HIV based vectors described in U.S. Pat. Nos. 6,143,520; 5,665,557; and 5,981,276, which are herein incorporated by reference.

Adenoviruses are also contemplated for use in delivery of iRNAs. Adenoviruses are especially attractive vehicles, e.g., for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, Current Opinion in Genetics and Development 3:499-503 (1993) present a review of adenovirus-based gene therapy. Bout et al., Human Gene Therapy 5:3-10 (1994) demonstrated the use of adenovirus vectors to transfer genes to the respiratory epithelia of rhesus monkeys. Other instances of the use of adenoviruses in gene therapy can be found in Rosenfeld et al., Science 252:431-434 (1991); Rosenfeld et al., Cell 68:143-155 (1992); Mastrangeli et al., J. Clin. Invest. 91:225-234 (1993); PCT Publication WO94/12649; and Wang, et al., Gene Therapy 2:775-783 (1995). A suitable AV vector for expressing an iRNA featured in the invention, a method for constructing the recombinant AV vector, and a method for delivering the vector into target cells, are described in Xia H et al. (2002), Nat. Biotech. 20: 1006-1010.

Use of Adeno-associated virus (AAV) vectors is also contemplated (Walsh et al., Proc. Soc. Exp. Biol. Med. 204:289-300 (1993); U.S. Pat. No. 5,436,146). In one embodiment, the iRNA can be expressed as two separate, complementary single-stranded RNA molecules from a recombinant AAV vector having, for example, either the U6 or H1 RNA promoters, or the cytomegalovirus (CMV) promoter. Suitable AAV vectors for expressing the dsRNA featured in the invention, methods for constructing the recombinant AV vector, and methods for delivering the vectors into target cells are described in Samulski R et al. (1987), J. Virol. 61: 3096-3101; Fisher K J et al. (1996), J. Virol, 70: 520-532; Samulski R et al. (1989), J. Virol. 63: 3822-3826; U.S. Pat. No. 5,252,479; U.S. Pat. No. 5,139,941; International Patent Application No. WO 94/13788; and International Patent Application No. WO 93/24641, the entire disclosures of which are herein incorporated by reference.

Another preferred viral vector is a pox virus such as a vaccinia virus, for example an attenuated vaccinia such as Modified Virus Ankara (MVA) or NYVAC, an avipox such as fowl pox or canary pox.

The tropism of viral vectors can be modified by pseudotyping the vectors with envelope proteins or other surface antigens from other viruses, or by substituting different viral capsid proteins, as appropriate. For example, lentiviral vectors can be pseudotyped with surface proteins from vesicular stomatitis virus (VSV), rabies, Ebola, Mokola, and the like. AAV vectors can be made to target different cells by engineering the vectors to express different capsid protein serotypes; see, e.g., Rabinowitz J E et al. (2002), J Virol 76:791-801, the entire disclosure of which is herein incorporated by reference.

The pharmaceutical preparation of a vector can include the vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

III. Pharmaceutical Compositions Containing iRNA

In one embodiment, the invention provides pharmaceutical compositions containing an iRNA, as described herein, and a pharmaceutically acceptable carrier. The pharmaceutical composition containing the iRNA is useful for treating a disease or disorder associated with the expression or activity of an EGLN gene, such as pathological processes mediated by EGLN expression. Such pharmaceutical compositions are formulated based on the mode of delivery. One example is compositions that are formulated for systemic administration via parenteral delivery, e.g., by intravenous (IV) delivery. Another example is compositions that are formulated for direct delivery into the brain parenchyma, e.g., by infusion into the brain, such as by continuous pump infusion.

The pharmaceutical compositions featured herein are administered in dosages sufficient to inhibit expression of EGLN genes. In general, a suitable dose of iRNA will be in the range of 0.01 to 200.0 milligrams per kilogram body weight of the recipient per day, generally in the range of 1 to 50 mg per kilogram body weight per day. For example, the dsRNA can be administered at 0.05 mg/kg, 0.5 mg/kg, 1 mg/kg, 1.5 mg/kg, 2 mg/kg, 3 mg/kg, 10 mg/kg, 20 mg/kg, 30 mg/kg, 40 mg/kg, or 50 mg/kg per single dose. The pharmaceutical composition may be administered once daily, or the iRNA may be administered as two, three, or more sub-doses at appropriate intervals throughout the day or even using continuous infusion or delivery through a controlled release formulation. In that case, the iRNA contained in each sub-dose must be correspondingly smaller in order to achieve the total daily dosage. The dosage unit can also be compounded for delivery over several days, e.g., using a conventional sustained release formulation which provides sustained release of the iRNA over a several day period. Sustained release formulations are well known in the art and are particularly useful for delivery of agents at a particular site, such as could be used with the agents of the present invention. In this embodiment, the dosage unit contains a corresponding multiple of the daily dose.

The effect of a single dose on EGLN levels can be long lasting, such that subsequent doses are administered at not more than 3, 4, or 5 day intervals, or at not more than 1, 2, 3, or 4 week intervals.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as described elsewhere herein.

Advances in mouse genetics have generated a number of mouse models for the study of various human diseases, such as pathological processes mediated by EGLN expression. Such models can be used for in vivo testing of iRNA, as well as for determining a therapeutically effective dose. A suitable mouse model is, for example, a mouse containing a transgene expressing human EGLN.

The present invention also includes pharmaceutical compositions and formulations that include the iRNA compounds featured in the invention. The pharmaceutical compositions of the present invention may be administered in a number of ways depending upon whether local or systemic treatment is desired and upon the area to be treated. Administration may be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular tissue, such as the liver (e.g., the hepatocytes of the liver).

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the invention may be encapsulated within liposomes or may form complexes thereto, in particular to cationic liposomes. Alternatively, iRNAs may be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

Liposomal Formulations

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are taken up by macrophages in vivo.

In order to traverse intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in Pharmaceutical Dosage Forms, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., Biochem. Biophys. Res. Commun., 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Several studies have assessed the topical delivery of liposomal drug formulations to the skin. Application of liposomes containing interferon to guinea pig skin resulted in a reduction of skin herpes sores while delivery of interferon via other means (e.g., as a solution or as an emulsion) were ineffective (Weiner et al., Journal of Drug Targeting, 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., Antiviral Research, 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al. S.T.P. Pharma. Sci., 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765).

Various liposomes comprising one or more glycolipids are known in the art. Papahadjopoulos et al. (Ann. N.Y. Acad. Sci., 1987, 507, 64) reported the ability of monosialoganglioside $G_{M1}$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{1215G}$, that contains a PEG moiety. Illum et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534, 899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.) Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al.

discloses protein-bonded liposomes and asserts that the contents of such liposomes may include a dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

Transfersomes are yet another type of liposomes, and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

Nucleic Acid Lipid Particles

In one embodiment, an EGLN dsRNA featured in the invention is fully encapsulated in the lipid formulation, e.g., to form a SPLP, pSPLP, SNALP, or other nucleic acid-lipid particle. As used herein, the term "SNALP" refers to a stable nucleic acid-lipid particle, including SPLP. As used herein, the term "SPLP" refers to a nucleic acid-lipid particle comprising plasmid DNA encapsulated within a lipid vesicle. SNALPs and SPLPs typically contain a cationic lipid, a non-cationic lipid, and a lipid that prevents aggregation of the particle (e.g., a PEG-lipid conjugate). SNALPs and SPLPs are extremely useful for systemic applications, as they exhibit extended circulation lifetimes following intravenous (i.v.) injection and accumulate at distal sites (e.g., sites physically separated from the administration site). SPLPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1.

The cationic lipid may be, for example, N,N-dioleyl-N,N-dimethylammonium chloride (DODAC), N,N-distearyl-N,N-dimethylammonium bromide (DDAB), N—(I-(2,3-dioleoyloxy)propyl)-N,N,N-trimethylammonium chloride (DOTAP), N—(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)—N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)

ethyl)piperazin-1-yl)ethylazanediyl)didodecan-2-ol (Tech G1), or a mixture thereof. The cationic lipid may comprise from about 20 mol % to about 50 mol % or about 40 mol % of the total lipid present in the particle.

In another embodiment, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In one embodiment, the lipid-siRNA particle includes 40% 2, 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The non-cationic lipid may be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid may be from about 5 mol % to about 90 mol %, about 10 mol %, or about 58 mol % if cholesterol is included, of the total lipid present in the particle.

The conjugated lipid that inhibits aggregation of particles may be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate may be, for example, a PEG-dilauryloxypropyl ($C_{12}$), a PEG-dimyristyloxypropyl ($C_{14}$), a PEG-dipalmityloxypropyl ($C_{16}$), or a PEG-distearyloxypropyl ($C_{18}$). The conjugated lipid that prevents aggregation of particles may be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

LNP01

In one embodiment, the lipidoid ND98.4HCl (MW 1487) (see U.S. patent application Ser. No. 12/056,230, filed Mar. 26, 2008, which is herein incorporated by reference), Cholesterol (Sigma-Aldrich), and PEG-Ceramide C16 (Avanti Polar Lipids) can be used to prepare lipid-dsRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

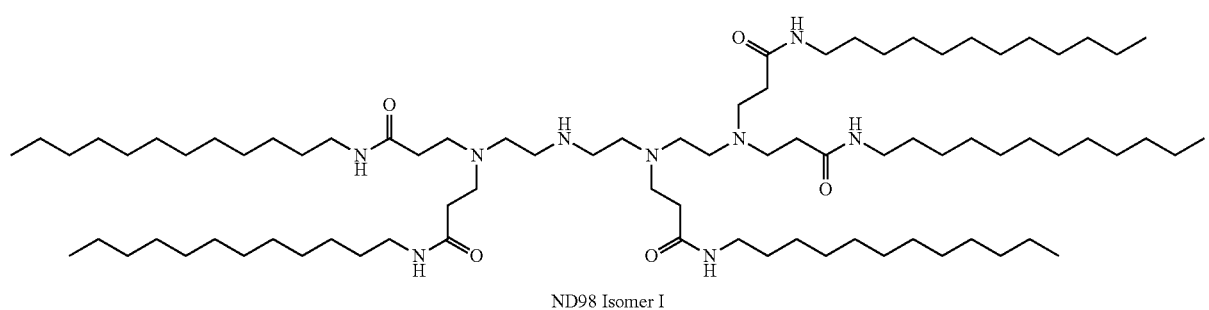

ND98 Isomer I

LNP01 formulations are described, e.g., in International Application Publication No. WO 2008/042973, which is hereby incorporated by reference.

Additional exemplary lipid-dsRNA formulations are as follows:

| | Cationic Lipid | cationic lipid/non-cationic lipid/cholesterol/PEG-lipid conjugate Lipid:siRNA ratio |
|---|---|---|
| SNALP | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA~7:1 |

| | Cationic Lipid | cationic lipid/non-cationic lipid/cholesterol/PEG-lipid conjugate Lipid:siRNA ratio |
|---|---|---|
| S-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis (2-hydroxydodecyl)amino)ethyl)(2-hydroxydodecyl)amino)ethyl)piperazin-1-yl)ethylazanediyl)didodecan-2-ol (C12-200) | C12-200/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000)

SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC comprising formulations are described, e.g., in U.S. Provisional Ser. No. 61/148,366, filed Jan. 29, 2009; U.S. Provisional Ser. No. 61/156,851, filed Mar. 2, 2009; U.S. Provisional Serial No. filed Jun. 10, 2009; U.S. Provisional Ser. No. 61/228,373, filed Jul. 24, 2009; U.S. Provisional Ser. No. 61/239,686, filed Sep. 3, 2009, and International Application No. PCT/US2010/022614, filed Jan. 29, 2010, which are hereby incorporated by reference.

MC3 comprising formulations are described, e.g., in U.S. Provisional Ser. No. 61/244,834, filed Sep. 22, 2009, U.S. Provisional Ser. No. 61/185,800, filed Jun. 10, 2009, and International Application No. PCT/US10/28224, filed Jun. 10, 2010, which are hereby incorporated by reference.

ALNY-100 comprising formulations are described, e.g., International patent application number PCT/US09/63933, filed on Nov. 10, 2009, which is hereby incorporated by reference.

C12-200 comprising formulations are described in U.S. Provisional Ser. No. 61/175,770, filed May 5, 2009 and International Application No. PCT/US10/33777, filed May 5, 2010, which are hereby incorporated by reference.

Synthesis of Cationic Lipids.

Any of the compounds, e.g., cationic lipids and the like, used in the nucleic acid-lipid particles of the invention may be prepared by known organic synthesis techniques, including the methods described in more detail in the Examples. All substituents are as defined below unless indicated otherwise.

"Alkyl" means a straight chain or branched, noncyclic or cyclic, saturated aliphatic hydrocarbon containing from 1 to 24 carbon atoms. Representative saturated straight chain alkyls include methyl, ethyl, n-propyl, n-butyl, n-pentyl, n-hexyl, and the like; while saturated branched alkyls include isopropyl, sec-butyl, isobutyl, tert-butyl, isopentyl, and the like. Representative saturated cyclic alkyls include cyclopropyl, cyclobutyl, cyclopentyl, cyclohexyl, and the like; while unsaturated cyclic alkyls include cyclopentenyl and cyclohexenyl, and the like.

"Alkenyl" means an alkyl, as defined above, containing at least one double bond between adjacent carbon atoms. Alkenyls include both cis and trans isomers. Representative straight chain and branched alkenyls include ethylenyl, propylenyl, 1-butenyl, 2-butenyl, isobutylenyl, 1-pentenyl, 2-pentenyl, 3-methyl-1-butenyl, 2-methyl-2-butenyl, 2,3-dimethyl-2-butenyl, and the like.

"Alkynyl" means any alkyl or alkenyl, as defined above, which additionally contains at least one triple bond between adjacent carbons. Representative straight chain and branched alkynyls include acetylenyl, propynyl, 1-butynyl, 2-butynyl, 1-pentynyl, 2-pentynyl, 3-methyl-1 butynyl, and the like.

"Acyl" means any alkyl, alkenyl, or alkynyl wherein the carbon at the point of attachment is substituted with an oxo group, as defined below. For example, —C(=O)alkyl, —C(=O)alkenyl, and —C(=O)alkynyl are acyl groups.

"Heterocycle" means a 5- to 7-membered monocyclic, or 7- to 10-membered bicyclic, heterocyclic ring which is either saturated, unsaturated, or aromatic, and which contains from 1 or 2 heteroatoms independently selected from nitrogen, oxygen and sulfur, and wherein the nitrogen and sulfur heteroatoms may be optionally oxidized, and the nitrogen heteroatom may be optionally quaternized, including bicyclic rings in which any of the above heterocycles are fused to a benzene ring. The heterocycle may be attached via any heteroatom or carbon atom. Heterocycles include heteroaryls as defined below. Heterocycles include morpholinyl, pyrrolidinonyl, pyrrolidinyl, piperidinyl, piperizynyl, hydantoinyl, valerolactamyl, oxiranyl, oxetanyl, tetrahydrofuranyl, tetrahydropyranyl, tetrahydropyridinyl, tetrahydroprimidinyl, tetrahydrothiophenyl, tetrahydrothiopyranyl, tetrahydropyrimidinyl, tetrahydrothiophenyl, tetrahydrothiopyranyl, and the like.

The terms "optionally substituted alkyl", "optionally substituted alkenyl", "optionally substituted alkynyl", "optionally substituted acyl", and "optionally substituted hetero-cycle" means that, when substituted, at least one hydrogen atom is replaced with a substituent. In the case of an oxo substituent (=O) two hydrogen atoms are replaced. In this regard, substituents include oxo, halogen, heterocycle, —CN, —OR$^x$, —NR$^x$R$^y$, —NR$^x$C(=O)R$^y$, —NR$^x$SO$_2$R$^y$, —C(=O)R$^x$, —C(=O)OR$^x$, —C(=O)NR$^x$R$^y$, —SO$_n$R$^x$ and —SO$_n$NR$^x$R$^y$, wherein n is 0, 1 or 2, R$^x$ and R$^y$ are the same or different and independently hydrogen, alkyl or heterocycle, and each of said alkyl and heterocycle substituents may be further substituted with one or more of oxo, halogen, —OH, —CN, alkyl, —OR$^x$, heterocycle, —NR$^x$R$^y$, —NR$^x$C(=O)R$^y$, —NR$^x$SO$_2$R$^y$, —C(=O)R$^x$, —C(=O)OR$^x$, —C(=O)NR$^x$ R$^y$, —SO$_n$R$^x$ and —SO$_n$NR$^x$R$^y$.

"Halogen" means fluoro, chloro, bromo and iodo.

In some embodiments, the methods of the invention may require the use of protecting groups. Protecting group methodology is well known to those skilled in the art (see, for example, PROTECTIVE GROUPS IN ORGANIC SYNTHESIS, Green, T. W. et al., Wiley-Interscience, New York City, 1999). Briefly, protecting groups within the context of this invention are any group that reduces or eliminates unwanted reactivity of a functional group. A protecting group can be added to a functional group to mask its reactivity during certain reactions and then removed to reveal the original functional group. In some embodiments an "alcohol protecting group" is used. An "alcohol protecting group" is any group which decreases or eliminates unwanted reactivity of an alcohol functional group. Protecting groups can be added and removed using techniques well known in the art.

Synthesis of Formula A

In one embodiments, nucleic acid-lipid particles of the invention are formulated using a cationic lipid of formula A:

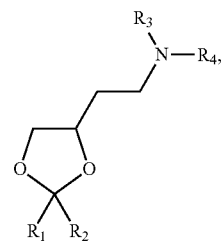

where R1 and R2 are independently alkyl, alkenyl or alkynyl, each can be optionally substituted, and R3 and R4 are independently lower alkyl or R3 and R4 can be taken together to form an optionally substituted heterocyclic ring. In some embodiments, the cationic lipid is XTC (2,2-Dilinoleyl-4-dimethylaminoethyl[1,3]-dioxolane). In general, the lipid of formula A above may be made by the following Reaction Schemes 1 or 2, wherein all substituents are as defined above unless indicated otherwise.

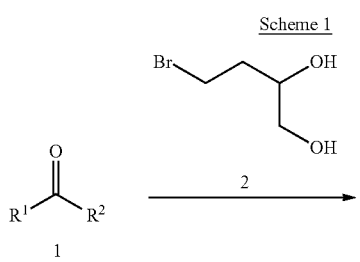

Scheme 1

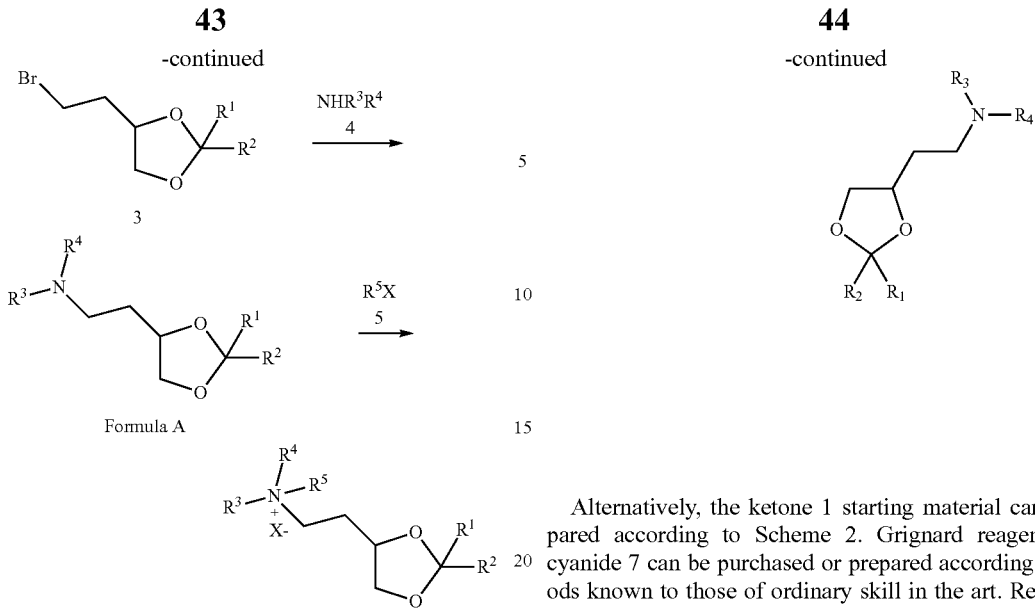

Lipid A, where $R_1$ and $R_2$ are independently alkyl, alkenyl or alkynyl, each can be optionally substituted, and $R_3$ and $R_4$ are independently lower alkyl or $R_3$ and $R_4$ can be taken together to form an optionally substituted heterocyclic ring, can be prepared according to Scheme 1. Ketone 1 and bromide 2 can be purchased or prepared according to methods known to those of ordinary skill in the art. Reaction of 1 and 2 yields ketal 3. Treatment of ketal 3 with amine 4 yields lipids of formula A. The lipids of formula A can be converted to the corresponding ammonium salt with an organic salt of formula 5, where X is anion counter ion selected from halogen, hydroxide, phosphate, sulfate, or the like.

Scheme 2

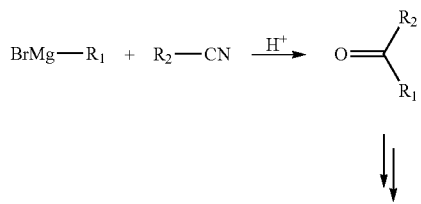

Alternatively, the ketone 1 starting material can be prepared according to Scheme 2. Grignard reagent 6 and cyanide 7 can be purchased or prepared according to methods known to those of ordinary skill in the art. Reaction of 6 and 7 yields ketone 1. Conversion of ketone 1 to the corresponding lipids of formula A is as described in Scheme 1.

Synthesis of MC3

Preparation of DLin-M-C3-DMA (i.e., (6Z,9Z,28Z,31Z)-heptatriaconta-6,9,28,31-tetraen-19-yl 4-(dimethylamino)butanoate) was as follows. A solution of (6Z,9Z,28Z,31Z)-heptatriaconta-6,9,28,31-tetraen-19-ol (0.53 g), 4-N,N-dimethylaminobutyric acid hydrochloride (0.51 g), 4-N,N-dimethylaminopyridine (0.61 g) and 1-ethyl-3-(3-dimethylaminopropyl)carbodiimide hydrochloride (0.53 g) in dichloromethane (5 mL) was stirred at room temperature overnight. The solution was washed with dilute hydrochloric acid followed by dilute aqueous sodium bicarbonate. The organic fractions were dried over anhydrous magnesium sulphate, filtered and the solvent removed on a rotovap. The residue was passed down a silica gel column (20 g) using a 1-5% methanol/dichloromethane elution gradient. Fractions containing the purified product were combined and the solvent removed, yielding a colorless oil (0.54 g).

Synthesis of ALNY-100

Synthesis of ketal 519 [ALNY-100] was performed using the following scheme 3:

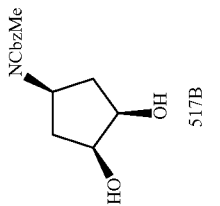
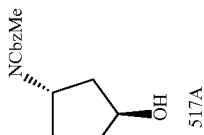
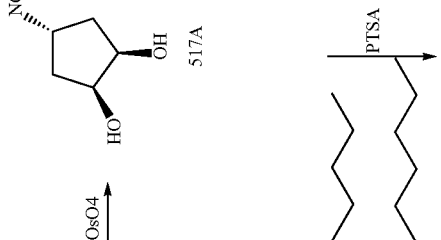
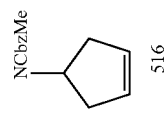
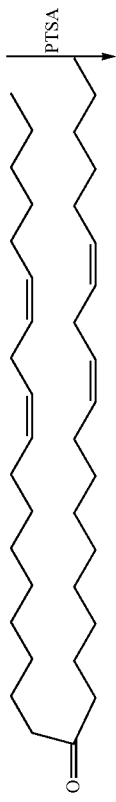
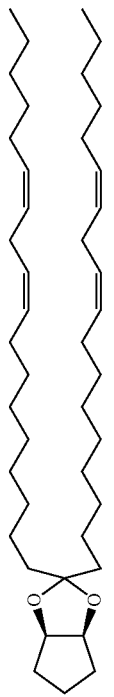
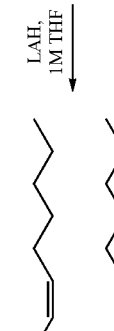

Synthesis of 515:

To a stirred suspension of LiAlH4 (3.74 g, 0.09852 mol) in 200 ml anhydrous THF in a two neck RBF (1 L), was added a solution of 514 (10 g, 0.04926 mol) in 70 mL of THF slowly at 0° C. under nitrogen atmosphere. After complete addition, reaction mixture was warmed to room temperature and then heated to reflux for 4 h. Progress of the reaction was monitored by TLC. After completion of reaction (by TLC) the mixture was cooled to 0° C. and quenched with careful addition of saturated Na2SO4 solution. Reaction mixture was stirred for 4 h at room temperature and filtered off. Residue was washed well with THF. The filtrate and washings were mixed and diluted with 400 mL dioxane and 26 mL conc. HCl and stirred for 20 minutes at room temperature. The volatilities were stripped off under vacuum to furnish the hydrochloride salt of 515 as a white solid. Yield: 7.12 g 1H-NMR (DMSO, 400 MHz): δ=9.34 (broad, 2H), 5.68 (s, 2H), 3.74 (m, 1H), 2.66-2.60 (m, 2H), 2.50-2.45 (m, 5H).

Synthesis of 516:

To a stirred solution of compound 515 in 100 mL dry DCM in a 250 mL two neck RBF, was added NEt3 (37.2 mL, 0.2669 mol) and cooled to 0° C. under nitrogen atmosphere. After a slow addition of N-(benzyloxy-carbonyloxy)-succinimide (20 g, 0.08007 mol) in 50 mL dry DCM, reaction mixture was allowed to warm to room temperature. After completion of the reaction (2-3 h by TLC) mixture was washed successively with 1N HCl solution (1×100 mL) and saturated NaHCO3 solution (1×50 mL). The organic layer was then dried over anhyd. Na2SO4 and the solvent was evaporated to give crude material which was purified by silica gel column chromatography to get 516 as sticky mass. Yield: 11 g (89%). 1H-NMR (CDCl3, 400 MHz): δ=7.36-7.27 (m, 5H), 5.69 (s, 2H), 5.12 (s, 2H), 4.96 (br., 1H) 2.74 (s, 3H), 2.60 (m, 2H), 2.30-2.25 (m, 2H). LC-MS [M+H] −232.3 (96.94%).

Synthesis of 517A and 517B:

The cyclopentene 516 (5 g, 0.02164 mol) was dissolved in a solution of 220 mL acetone and water (10:1) in a single neck 500 mL RBF and to it was added N-methyl morpholine-N-oxide (7.6 g, 0.06492 mol) followed by 4.2 mL of 7.6% solution of OsO4 (0.275 g, 0.00108 mol) in tert-butanol at room temperature. After completion of the reaction (~3 h), the mixture was quenched with addition of solid Na2SO3 and resulting mixture was stirred for 1.5 h at room temperature. Reaction mixture was diluted with DCM (300 mL) and washed with water (2×100 mL) followed by saturated NaHCO3 (1×50 mL) solution, water (1×30 mL) and finally with brine (lx 50 mL). Organic phase was dried over an. Na2SO4 and solvent was removed in vacuum. Silica gel column chromatographic purification of the crude material was afforded a mixture of diastereomers, which were separated by prep HPLC. Yield: ~6 g crude 517A—Peak-1 (white solid), 5.13 g (96%). 1H-NMR (DMSO, 400 MHz): δ=7.39-7.31 (m, 5H), 5.04 (s, 2H), 4.78-4.73 (m, 1H), 4.48-4.47 (d, 2H), 3.94-3.93 (m, 2H), 2.71 (s, 3H), 1.72-1.67 (m, 4H). LC-MS −[M+H] −266.3, [M+NH4+] −283.5 present, HPLC −97.86%. Stereochemistry confirmed by X-ray.

Synthesis of 518:

Using a procedure analogous to that described for the synthesis of compound 505, compound 518 (1.2 g, 41%) was obtained as a colorless oil. 1H-NMR (CDCl3, 400 MHz): δ=7.35-7.33 (m, 4H), 7.30-7.27 (m, 1H), 5.37-5.27 (m, 8H), 5.12 (s, 2H), 4.75 (m, 1H), 4.58-4.57 (m, 2H), 2.78-2.74 (m, 7H), 2.06-2.00 (m, 8H), 1.96-1.91 (m, 2H), 1.62 (m, 4H), 1.48 (m, 2H), 1.37-1.25 (br m, 36H), 0.87 (m, 6H). HPLC −98.65%.

General Procedure for the Synthesis of Compound 519:

A solution of compound 518 (1 eq) in hexane (15 mL) was added in a drop-wise fashion to an ice-cold solution of LAH in THF (1 M, 2 eq). After complete addition, the mixture was heated at 40° C. over 0.5 h then cooled again on an ice bath. The mixture was carefully hydrolyzed with saturated aqueous Na2SO4 then filtered through celite and reduced to an oil. Column chromatography provided the pure 519 (1.3 g, 68%) which was obtained as a colorless oil. 13C NMR □=130.2, 130.1 (×2), 127.9 (×3), 112.3, 79.3, 64.4, 44.7, 38.3, 35.4, 31.5, 29.9 (×2), 29.7, 29.6 (×2), 29.5 (×3), 29.3 (×2), 27.2 (×3), 25.6, 24.5, 23.3, 226, 14.1; Electrospray MS (+ve): Molecular weight for C44H80NO2 (M+H)+ Calc. 654.6. Found 654.6.

Formulations prepared by either the standard or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano ZS (Malvern, USA). Particles should be about 20-300 nm, such as 40-100 nm in size. The particle size distribution should be unimodal. The total dsRNA concentration in the formulation, as well as the entrapped fraction, is estimated using a dye exclusion assay. A sample of the formulated dsRNA can be incubated with an RNA-binding dye, such as Ribogreen (Molecular Probes) in the presence or absence of a formulation disrupting surfactant, e.g., 0.5% Triton-X100. The total dsRNA in the formulation can be determined by the signal from the sample containing the surfactant, relative to a standard curve. The entrapped fraction is determined by subtracting the "free" dsRNA content (as measured by the signal in the absence of surfactant) from the total dsRNA content. Percent entrapped dsRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. In some embodiments, oral formulations are those in which dsRNAs featured in the invention are administered in conjunction with one or more penetration enhancers surfactants and chelators. Suitable surfactants include fatty acids and/or esters or salts thereof, bile acids and/or salts thereof. Suitable bile acids/salts include chenodeoxycholic acid (CDCA) and ursodeoxychenodoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention may be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration may include sterile aqueous solutions which may also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention may be formulated into any of many possible dosage forms such as, but not limited to, tablets, capsules, gel capsules, liquid syrups, soft gels, suppositories, and enemas. The compositions of the present invention may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

Additional Formulations
Emulsions

The compositions of the present invention may be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions may be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions may contain additional components in addition to the dispersed phases, and the active drug which may be present as a solution in either the aqueous phase, oily phase or itself as a separate phase. Pharmaceutical excipients such as emulsifiers, stabilizers, dyes, and anti-oxidants may also be present in emulsions as needed. Pharmaceutical emulsions may also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion may be a semisolid or a solid, as is the case of emulsion-style ointment bases and creams. Other means of stabilizing emulsions entail the use of emulsifiers that may be incorporated into either phase of the emulsion. Emulsifiers may broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.;

Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants may be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that may readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used may be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In one embodiment of the present invention, the compositions of iRNAs and nucleic acids are formulated as microemulsions. A microemulsion may be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions may form spontaneously when their components are brought together at ambient temperature. This may be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention may also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention may be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers are described below in greater detail.

Surfactants:

In connection with the present invention, surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, N.Y., 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Fatty Acids:

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, C1-20 alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, Mass., 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

Bile Salts:

The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating Agents:

Chelating agents, as used in connection with the present invention, can be defined as compounds that remove metallic ions from solution by forming complexes therewith, with the result that absorption of iRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, Mass., 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

Non-Chelating Non-Surfactants:

As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, Critical Reviews in Therapeutic Drug Carrier Systems, 1990, 7, 1-33). This class of penetration enhancers include, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of iRNAs at the cellular level may also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, Calif.), Lipofectamine 2000™ (Invitrogen; Carlsbad, Calif.), 293Fectin™ (Invitrogen; Carlsbad, Calif.), Cellfectin™ (Invitrogen; Carlsbad, Calif.), DMRIE-C™ (Invitrogen; Carlsbad, Calif.), FreeStyle™ MAX (Invitrogen; Carlsbad, Calif.), Lipofectamine™ 2000 CD (Invitrogen; Carlsbad, Calif.), Lipofectamine™ (Invitrogen; Carlsbad, Calif.), RNAiMAX (Invitrogen; Carlsbad, Calif.), Oligofectamine™ (Invitrogen; Carlsbad, Calif.), Optifect™ (Invitrogen; Carlsbad, Calif.), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, Wis.), TransFast™ Transfection Reagent (Promega; Madison, Wis.), Tfx™-20 Reagent (Promega; Madison, Wis.), Tfx™-50 Reagent (Promega; Madison, Wis.), DreamFect™ (OZ Biosciences; Marseille, France), EcoTransfect (OZ Biosciences; Marseille, France), TransPassa D1 Transfection Reagent (New England Biolabs; Ipswich, Mass., USA), LyoVec™/LipoGen™ (Invivogen; San Diego, Calif., USA), PerFectin Transfection Reagent (Genlantis; San Diego, Calif., USA), NeuroPORTER Transfection Reagent (Genlantis; San Diego, Calif., USA), GenePORTER Transfection reagent (Genlantis; San Diego, Calif., USA), GenePORTER 2 Transfection reagent (Genlantis; San Diego, Calif., USA), Cytofectin Transfection Reagent (Genlantis; San Diego, Calif., USA), BaculoPORTER Transfection Reagent (Genlantis; San Diego, Calif., USA), TroganPORTER™ transfection Reagent (Genlantis; San Diego, Calif., USA), RiboFect (Bioline; Taunton, Mass., USA), PlasFect (Bioline; Taunton, Mass., USA), UniFECTOR (B-Bridge International; Mountain View, Calif., USA), SureFECTOR (B-Bridge International; Mountain View, Calif., USA), or HiFect™ (B-Bridge International, Mountain View, Calif., USA), among others.

Other agents may be utilized to enhance the penetration of the administered nucleic acids, including glycols such as ethylene glycol and propylene glycol, pyrrols such as 2-pyrrol, azones, and terpenes such as limonene and menthone.

Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids may include sterile and non-sterile aqueous solutions, non-aqueous solutions in common solvents such as alcohols, or solutions of the nucleic acids in liquid or solid oil bases. The solutions may also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Other Components

The compositions of the present invention may additionally contain other adjunct components conventionally found in pharmaceutical compositions, at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions may contain substances that increase the viscosity of the suspension including, for example, sodium carboxymethylcellulose, sorbitol and/or dextran. The suspension may also contain stabilizers.

In some embodiments, pharmaceutical compositions featured in the invention include (a) one or more iRNA compounds and (b) one or more biologic agents which function by a non-RNAi mechanism.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured in the invention lies generally within a range of circulating concentrations that include the ED50 with little or no toxicity. The dosage may vary within this range depending upon the dosage form employed and the route of administration utilized. For any compound used in the methods featured in the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration, as discussed above, the iRNAs featured in the invention can be administered in combination with other known agents effective in treatment of pathological processes mediated by EGLN expression. In any event, the administering physician can adjust the amount and timing of iRNA administration on the basis of results observed using standard measures of efficacy known in the art or described herein.

Methods for Treating Diseases Caused by Expression of an EGLN Gene

The invention relates in particular to the use of an iRNA targeting EGLN and compositions containing at least one such iRNA for the treatment of an EGLN-mediated disorder or disease. For example, a composition containing an iRNA targeting at least one EGLN gene is used for treatment of anemia. As used herein, "anemia" refers to a condition whereby the body has fewer than necessary red blood cells thereby resulting in reduced oxygen to cells and tissues. Anemias may be caused by any of several disorders and include, but are not limited to anemia due to B12 deficiency, anemia due to folate deficiency, anemia due to iron deficiency, hemolytic anemia, hemolytic anemia due to G-6-PD deficiency, idiopathic aplastic anemia, idiopathic autoimmune hemolytic anemia, immune hemolytic anemia, iegaloblastic anemia, pernicious anemia, secondary aplastic anemia, and sickle cell anemia. Certain symptoms are associated with anemia and include pale skin, dizziness, fatigue, headaches, irritability, low body temperature, numb/cold hands or feet, rapid heartbeat, shortness of breath, weakness and chest pain any of which may be ameliorated by administration of the iRNA agents targeting one or more EGLN genes of the present invention.

In one embodiment at least one iRNA targeting at least one EGLN gene is used to downregulate hepcidin (GenBank Reference NG 011563.1; SEQ ID 2805 representing the complete gene on chromosome 19; and GenBank Reference NM_021175 representing the Hepcidin peptide; SEQ ID NO: 2806). Probes for the detection of hepcidin (HAMP1)

were purchased from Panomics (a division of Affymetrix, Santa Clara, Calif.) and can detect either HAMP1 or HAMP2. Hepcidin is a peptide hormone that is produced by the liver. It is believed that hepcidin binds to ion channel to inhibit iron transport out of the cells which store iron. The downregulation of hepcidin may result in increased mobilization of iron in the body.

In one embodiment at least one iRNA targeting at least one EGLN gene is used for the treatment of cancer. As used herein "cancer" refers to any of various malignant neoplasms characterized by the proliferation of anaplastic cells that tend to invade surrounding tissue and metastasize to new body sites and also refers to the pathological condition characterized by such malignant neoplastic growths. A cancer can be a tumor or hematological malignancy, and includes but is not limited to, all types of cancers but preferably leukemias, and those arising in the blood or bone.

Leukemias, or cancers of the blood or bone marrow that are characterized by an abnormal proliferation of white blood cells i.e., leukocytes, can be divided into four major classifications including Acute lymphoblastic leukemia (ALL), Chronic lymphocytic leukemia (CLL), Acute myelogenous leukemia or acute myeloid leukemia (AML) (AML with translocations between chromosome 10 and 11 [t(10, 11)], chromosome 8 and 21 [t(8; 21)], chromosome 15 and 17 [t(15; 17)], and inversions in chromosome 16 [inv(16)]; AML with multilineage dysplasia, which includes patients who have had a prior myelodysplastic syndrome (MDS) or myeloproliferative disease that transforms into AML; AML and myelodysplastic syndrome (MDS), therapy-related, which category includes patients who have had prior chemotherapy and/or radiation and subsequently develop AML or MDS; d) AML not otherwise categorized, which includes subtypes of AML that do not fall into the above categories; and e) Acute leukemias of ambiguous lineage, which occur when the leukemic cells can not be classified as either myeloid or lymphoid cells, or where both types of cells are present); and Chronic myelogenous leukemia (CML). These types of leukemias are particularly amenable to treatment with the iRNA agents of the present invention.

The invention further relates to the use of an iRNA or a pharmaceutical composition thereof, e.g., for treating anemia or cancer, in combination with other pharmaceuticals and/or other therapeutic methods, e.g., with known pharmaceuticals and/or known therapeutic methods, such as, for example, those which are currently employed for treating these disorders. For example, the iRNA or pharmaceutical composition thereof can also be administered in conjunction with one or more additional anti-cancer treatments, such as biological, chemotherapy and radiotherapy. Accordingly, a treatment can include, for example, imatinib (Gleevac), all-trans-retinoic acid, a monoclonal antibody treatment (gemtuzumab, ozogamicin), chemotherapy (for example, chlorambucil, prednisone, prednisolone, vincristine, cytarabine, clofarabine, farnesyl transferase inhibitors, decitabine, inhibitors of MDR1), rituximab, interferon-α, anthracycline drugs (such as daunorubicin or idarubicin), L-asparaginase, doxorubicin, cyclophosphamide, doxorubicin, bleomycin, fludarabine, etoposide, pentostatin, or cladribine), bone marrow transplant, stem cell transplant, radiation therapy, anti-metabolite drugs (methotrexate and 6-mercaptopurine), or any combination thereof.

In one embodiment, the iRNA agents of the present invention may be administered in combination with an iron supplement. The administration may be simultaneously, together, or apart. The dosing may be on the same schedule, an offset schedule or a one time administration of the iron supplement. The iron supplement may be given on an "as needed" basis depending on measurements made in the particular patient.

Radiation therapy (also called radiotherapy, X-ray therapy, or irradiation) is the use of ionizing radiation to kill cancer cells and shrink tumors. Radiation therapy can be administered externally via external beam radiotherapy (EBRT) or internally via brachytherapy. The effects of radiation therapy are localised and confined to the region being treated. Radiation therapy may be used to treat almost every type of solid tumor, including cancers of the brain, breast, cervix, larynx, lung, pancreas, prostate, skin, stomach, uterus, or soft tissue sarcomas. Radiation is also used to treat leukemia and lymphoma.

Chemotherapy is the treatment of cancer with drugs that can destroy cancer cells. In current usage, the term "chemotherapy" usually refers to cytotoxic drugs which affect rapidly dividing cells in general, in contrast with targeted therapy. Chemotherapy drugs interfere with cell division in various possible ways, e.g. with the duplication of DNA or the separation of newly formed chromosomes. Most forms of chemotherapy target all rapidly dividing cells and are not specific to cancer cells, although some degree of specificity may come from the inability of many cancer cells to repair DNA damage, while normal cells generally can. Most chemotherapy regimens are given in combination. Exemplary chemotherapeutic agents include, but are not limited to, 5-FU Enhancer, 9-AC, AG2037, AG3340, Aggrecanase Inhibitor, Aminoglutethimide, Amsacrine (m-AMSA), Asparaginase, Azacitidine, Batimastat (BB94), BAY 12-9566, BCH-4556, Bis-Naphtalimide, Busulfan, Capecitabine, Carboplatin, Carmustaine+Polifepr Osan, cdk4/cdk2 inhibitors, Chlorombucil, CI-994, Cisplatin, Cladribine, CS-682, Cytarabine HCl, D2163, Dactinomycin, Daunorubicin HCl, DepoCyt, Dexifosamide, Docetaxel, Dolastain, Doxifluridine, Doxorubicin, DX8951f, E 7070, EGFR, Epirubicin, Erythropoietin, Estramustine phosphate sodium, Etoposide (VP16-213), Farnesyl Transferase Inhibitor, FK 317, Flavopiridol, Floxuridine, Fludarabine, Fluorouracil (5-FU), Flutamide, Fragyline, Gemcitabine, Hexamethylmelamine (HMM), Hydroxyurea (hydroxycarbamide), Ifosfamide, Interferon Alfa-2a, Interferon Alfa-2b, Interleukin-2, Irinotecan, ISI 641, Krestin, Lemonal DP 2202, Leuprolide acetate (LHRH-releasing factor analogue), Levamisole, LiGLA (lithium-gamma linolenate), Lodine Seeds, Lometexol, Lomustine (CCNU), Marimistat, Mechlorethamine HCl (nitrogen mustard), Megestrol acetate, Meglamine GLA, Mercaptopurine, Mesna, Mitoguazone (methyl-GAG; methyl glyoxal bis-guanylhydrazone; MGBG), Mitotane (o.p'-DDD), Mitoxantrone, Mitoxantrone HCl, MMI 270, MMP, MTA/LY 231514, Octreotide, ODN 698, OK-432, Oral Platinum, Oral Taxoid, Paclitaxel (TAXOL®), PARP Inhibitors, PD 183805, Pentostatin (2' deoxycoformycin), PKC 412, Plicamycin, Procarbazine HCl, PSC 833, Ralitrexed, RAS Farnesyl Transferase Inhibitor, RAS Oncogene Inhibitor, Semustine (methyl-CCNU), Streptozocin, Suramin, Tamoxifen citrate, Taxane Analog, Temozolomide, Teniposide (VM-26), Thioguanine, Thiotepa, Topotecan, Tyrosine Kinase, UFT (Tegafur/Uracil), Valrubicin, Vinblastine sulfate, Vindesine sulfate, VX-710, VX-853, YM 116, ZD 0101, ZD 0473/Anormed, ZD 1839, ZD 9331.

Biological therapies use the body's immune system, either directly or indirectly, to fight cancer or to lessen the side effects that may be caused by some cancer treatments. In one sense, targeting one or more EGLN genes can be considered in this group of therapies in that it can stimulate immune system action against a tumor, for example. However, this approach can also be considered with other such biological approaches, e.g., immune response modifying therapies such as the administration of interferons, interleukins, colony-stimulating factors, monoclonal antibodies, vaccines, gene therapy, and nonspecific immunomodulating agents are also envisioned as anti-cancer therapies to be combined with the inhibition of EGLN. Small molecule targeted therapy drugs are generally inhibitors of enzymatic domains on mutated, overexpressed, or otherwise critical proteins within the cancer cell, such as tyrosine kinase inhibitors imatinib (Gleevec/Glivec) and gefitinib (Iressa). Examples of monoclonal antibody therapies that can be used with an iRNA or pharmaceutical composition thereof include, but are not limited to, the anti-HER2/neu antibody trastuzumab (Herceptin) used in breast cancer, and the anti-CD20 antibody rituximab, used in a variety of B-cell malignancies. The growth of some cancers can be inhibited by providing or blocking certain hormones. Common examples of hormone-sensitive tumors include certain types of breast and prostate cancers. Removing or blocking estrogen or testosterone is often an important additional treatment. In certain cancers, administration of hormone agonists, such as progestogens may be therapeutically beneficial.

Cancer immunotherapy refers to a diverse set of therapeutic strategies designed to induce the patient's own immune system to fight the tumor, and include, but are not limited to, intravesical BCG immunotherapy for superficial bladder cancer, vaccines to generate specific immune responses, such as for malignant melanoma and renal cell carcinoma, and the use of Sipuleucel-T for prostate cancer, in which dendritic cells from the patient are loaded with prostatic acid phosphatase peptides to induce a specific immune response against prostate-derived cells.

In some embodiments, an iRNA targeting one or more EGLN genes is administered in combination with an angiogenesis inhibitor. In some embodiments, the angiogenesis inhibitors for use in the methods described herein include, but are not limited to, monoclonal antibody therapies directed against specific pro-angiogenic growth factors and/or their receptors. Examples of these are: bevacizumab (Avastin®), cetuximab (Erbitux®), panitumumab (Vectibix™), and trastuzumab (Herceptin®). In some embodiments, the angiogenesis inhibitors for use in the methods described herein include but are not limited to small molecule tyrosine kinase inhibitors (TKIs) of multiple pro-angiogenic growth factor receptors. The three TKIs that are currently approved as anti-cancer therapies are erlotinib (Tarceva®), sorafenib (Nexavar®), and sunitinib (Sutent®). In some embodiments, the angiogenesis inhibitors for use in the methods described herein include but are not limited to inhibitors of mTOR (mammalian target of rapamycin) such as temsirolimus (Toricel™), bortezomib (Velcade®), thalidomide (Thalomid®), and Doxycyclin.

In other embodiments, the angiogenesis inhibitors for use in the methods described herein include one or more drugs that target the VEGF pathway, including, but not limited to, Bevacizumab (Avastin®), sunitinib (Sutent®), and sorafenib (Nexavar®). Additional VEGF inhibitors include CP-547,632 (3-(4-Bromo-2,6-difluoro-benzyloxy)-5-[3-(4-pyrrolidin 1-yl-butyl)-ureido]-isothiazole-4-carboxylic acid amide hydrochloride; Pfizer Inc., NY), AG13736, AG28262 (Pfizer Inc.), SU5416, SU11248, & SU6668 (formerly Sugen Inc., now Pfizer, New York, N.Y.), ZD-6474 (AstraZeneca), ZD4190 which inhibits VEGF-R2 and -R1 (AstraZeneca), CEP-7055 (Cephalon Inc., Frazer, Pa.), PKC 412 (Novartis), AEE788 (Novartis), AZD-2171), NEXAVAR® (BAY 43-9006, sorafenib; Bayer Pharmaceuticals and Onyx Pharmaceuticals), vatalanib (also known as PTK-787, ZK-222584: Novartis & Schering: AG), MACUGEN® (pegaptanib octasodium, NX-1838, EYE-001, Pfizer Inc./Gilead/Eyetech), IM862 (glufanide disodium, Cytran Inc. of Kirkland, Wash., USA), VEGFR2-selective monoclonal antibody DC101 (ImClone Systems, Inc.), angiozyme, a synthetic ribozyme from Ribozyme (Boulder, Colo.) and Chiron (Emeryville, Calif.), Sirna-027 (an siRNA-based VEGFR1 inhibitor, Sirna Therapeutics, San Francisco, Calif.) Caplostatin, soluble ectodomains of the VEGF receptors, Neovastat (Æ terna Zentaris Inc; Quebec City, Calif.), ZM323881 (CalBiochem. CA, USA), pegaptanib (Macugen) (Eyetech Pharmaceuticals), an anti-VEGF aptamer and combinations thereof.

In other embodiments, the angiogenesis inhibitors for use in the methods described herein include anti-angiogenic factors such as alpha-2 antiplasmin (fragment), angiostatin (plasminogen fragment), antiangiogenic antithrombin III, cartilage-derived inhibitor (CDI), CD59 complement fragment, endostatin (collagen XVIII fragment), fibronectin fragment, gro-beta (a C-X-C chemokine), heparinases heparin hexasaccharide fragment, human chorionic gonadotropin (hCG), interferon alpha/beta/gamma, interferon inducible protein (IP-10), interleukin-12, kringle 5 (plasminogen fragment), beta-thromboglobulin, EGF (fragment), VEGF inhibitor, endostatin, fibronection (45 kD fragment), high molecular weight kininogen (domain 5), NK1, NK2, NK3 fragments of HGF, PF-4, serpin proteinase inhibitor 8, TGF-beta-1, thrombospondin-1, prosaposin, p53, angioarrestin, metalloproteinase inhibitors (TIMPs), 2-Methoxyestradiol, placental ribonuclease inhibitor, plasminogen activator inhibitor, prolactin 16 kD fragment, proliferin-related protein (PRP), retinoids, tetrahydrocortisol-S transforming growth factor-beta (TGF-b), vasculostatin, and vasostatin (calreticulin fragment).pamidronate thalidomide, TNP470, the bisphosphonate family such as amino-bisphosphonate zoledronic acid. bombesin/gastrin-releasing peptide (GRP) antagonists such as RC-3095 and RC-3940-II (Bajol A M, et. al., British Journal of Cancer (2004) 90, 245-252), anti-VEGF peptide (dRK6) (Seung-Ah Yoo, J. Immuno, 2005, 174: 5846-5855).

Efficacy of treatment or amelioration of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. In connection with the administration of an iRNA targeting one or more EGLN genes or pharmaceutical composition thereof, "effective against" a cancer indicates that administration in a clinically appropriate manner results in a beneficial effect for at least a statistically significant fraction of patients, such as a improvement of symptoms, a cure, a reduction in disease load, reduction in tumor mass or cell numbers, extension of life, improvement in quality of life, or other effect generally recognized as positive by medical doctors familiar with treating the particular type of cancer.

In one embodiment the disorder is anemia where efficacy of treatment can be determined by measuring standard endpoints associated with improvement anemia due to B12 deficiency, anemia due to folate deficiency, anemia due to iron deficiency, hemolytic anemia, hemolytic anemia due to G-6-PD deficiency, idiopathic aplastic anemia, idiopathic autoimmune hemolytic anemia, immune hemolytic anemia, iegaloblastic anemia, pernicious anemia, secondary aplastic anemia, and sickle cell anemia. For example, an improvement in any of the manifestations of anemia such as pale skin, dizziness, fatigue, headaches, irritability, low body temperature, numb/cold hands or feet, rapid heartbeat, reduced erythropoietin, shortness of breath, weakness and chest pain would be considered indicative of effective treatment.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA drug or formulation of that drug can also be judged using an experimental animal model for the given disease as known in the art. When using an experimental animal model, efficacy of treatment is evidenced when a statistically significant reduction in a marker or symptom is observed.

The invention relates in particular to the use of one or more iRNA targeting one or more EGLN genes and compositions containing at least one such iRNA for the treatment of an EGLN-mediated disorder or disease. For example, a composition containing an iRNA targeting an EGLN gene is used for treatment of an infectious disease or disorder, for example, in a subject having an infection. In some preferred embodiments the subject has an infection or is at risk of having an infection. An "infection" as used herein refers to a disease or condition attributable to the presence in a host of a foreign organism or agent that reproduces within the host. Infections typically involve breach of a normal mucosal or other tissue barrier by an infectious organism or agent. A subject that has an infection is a subject having objectively measurable infectious organisms or agents present in the subject's body. A subject at risk of having an infection is a subject that is predisposed to develop an infection. Such a subject can include, for example, a subject with a known or suspected exposure to an infectious organism or agent. A subject at risk of having an infection also can include a subject with a condition associated with impaired ability to mount an immune response to an infectious organism or agent, e.g., a subject with a congenital or acquired immunodeficiency, a subject undergoing radiation therapy or chemotherapy, a subject with a burn injury, a subject with a traumatic injury, a subject undergoing surgery or other invasive medical or dental procedure.

Infections are broadly classified as bacterial, viral, fungal, or parasitic based on the category of infectious organism or agent involved. Other less common types of infection are also known in the art, including, e.g., infections involving rickettsiae, mycoplasmas, and agents causing scrapie, bovine spongiform encephalopthy (BSE), and prion diseases (e.g., kuru and Creutzfeldt-Jacob disease). Examples of bacteria, viruses, fungi, and parasites which cause infection are well known in the art. An infection can be acute, subacute, chronic, or latent, and it can be localized or systemic. As defined herein, a "chronic infection" refers to those infections that are not cleared by the normal actions of the innate or adaptive immune responses and persist in the subject for a long duration of time, on the order of weeks, months, and years. A chronic infection may reflect latency of the infectious agent, and may be include periods in which no infectious symptoms are present, i.e., asymptomatic periods. Examples of chronic infections include, but are not limited to, HIV infection and herpesvirus infections. Furthermore, an infection can be predominantly intracellular or extracellular during at least one phase of the infectious organism's or agent's life cycle in the host.

Exemplary viruses include, but are not limited to: Retroviridae (e.g., human immunodeficiency viruses, such as HIV-1 (also referred to as HTLV-III), HIV-2, LAV or HTLV-III/LAV, or HIV-III, and other isolates, such as HIV-LP; Picornaviridae (e.g., polio viruses, hepatitis A virus; enteroviruses, human Coxsackie viruses, rhinoviruses, echoviruses); Calci viridae (e.g., strains that cause gastroenteritis); Togaviridae (e.g., equine encephalitis viruses, rubella viruses); Flaviridae (e.g., dengue viruses, encephalitis viruses, yellow fever viruses); Coronaviridae (e.g., coronaviruses); Rhabdoviridae (e.g., vesicular stomatitis viruses, rabies viruses); Filoviridae (e.g., ebola viruses); Paramyxoviridae (e.g., parainfluenza viruses, mumps virus, measles virus, respiratory syncytial virus); adenovirus; Orthomyxoviridae (e.g., influenza viruses); Bungaviridae (e.g., Hantaan viruses, bunga viruses, phleboviruses and Nairo viruses); Arena viridae (hemorrhagic fever viruses); Reoviridae (e.g., reoviruses, orbiviurses and rotaviruses, i.e., Rotavirus A, Rotavirus B. Rotavirus C); Birnaviridae; Hepadnaviridae (Hepatitis A and B viruses); Parvoviridae (parvoviruses); Papovaviridae (papilloma viruses, polyoma viruses); Adenoviridae (most adenoviruses); Herpesviridae (herpes simplex virus (HSV) 1 and 2, Human herpes virus 6, Human herpes virus 7, Human herpes virus 8, varicella zoster virus, cytomegalovirus (CMV), herpes virus; Epstein-Barr virus; Rous sarcoma virus; West Nile virus; Japanese equine encephalitis, Norwalk, papilloma virus, parvovirus B19; Poxyiridae (variola viruses, vaccinia viruses, pox viruses); and Iridoviridae (e.g., African swine fever virus); Hepatitis D virus, Hepatitis E virus, and unclassified viruses (e.g., the etiological agents of Spongiform encephalopathies, the agent of delta hepatitis (thought to be a defective satellite of hepatitis B virus), the agents of non-A, non-B hepatitis (class 1=enterally transmitted; class 2=parenterally transmitted (i.e., Hepatitis C); Norwalk and related viruses, and astroviruses).

Bacteria include both Gram negative and Gram positive bacteria. Examples of Gram positive bacteria include, but are not limited to *Pasteurella* species, Staphylococci species, and *Streptococcus* species. Examples of Gram negative bacteria include, but are not limited to, *Escherichia coli*, *Pseudomonas* species, and *Salmonella* species. Specific examples of infectious bacteria include but are not limited to: *Helicobacter pyloris, Borrelia burgdorferi, Legionella pneumophilia, Mycobacteria* spp. (e.g., *M. tuberculosis, M. avium, M. intracellulare, M. kansasii, M. gordonae, M. leprae*), *Staphylococcus aureus, Neisseria gonorrhoeae, Neisseria meningitidis, Listeria monocytogenes, Streptococcus pyogenes* (Group A *Streptococcus*), *Streptococcus agalactiae* (Group B *Streptococcus*), *Streptococcus* (viridans group), *Streptococcus faecalis, Streptococcus bovis, Streptococcus* (anaerobic spp.), *Streptococcus pneumoniae*, pathogenic *Campylobacter* spp., *Enterococcus* spp., *Haemophilus influenzae* (Hemophilus influenza B, and Hemophilus influenza non-typable), *Bacillus anthraces, Corynebacterium diphtheriae, Corynebacterium* spp., *Erysipelothrix rhusiopathiae, Clostridium perfringens, Clostridium tetani, Enterobacter aerogenes, Klebsiella pneumoniae, Pasteurella multocida, Bacteroides* spp., *Fusobacterium nucleatum, Streptobacillus moniliformis, Treponema pallidum, Treponema pertenue, Leptospira*,

*Rickettsia, Actinomyces israelii*, meningococcus, pertussis, pneumococcus, *shigella*, tetanus, *Vibrio cholerae, yersinia, Pseudomonas* species, Clostridia species, *Salmonella typhi, Shigella dysenteriae, Yersinia pestis, Brucella* species, *Legionella pneumophila, Rickettsiae, Chlamydia, Clostridium perfringens, Clostridium botulinum, Staphylococcus aureus, Pseudomonas aeruginosa, Cryptosporidium parvum, Streptococcus pneumoniae*, and *Bordetella pertussis*.

Exemplary fungi and yeast include, but are not limited to, *Cryptococcus neoformans, Candida albicans, Candida tropicalis, Candida stellatoidea, Candida glabrata, Candida krusei, Candida parapsilosis, Candida guilliermondii, Candida viswanathii, Candida lusitaniae, Rhodotorula mucilaginosa, Aspergillus fumigatus, Aspergillus flavus, Blastomyces dermatitidis, Aspergillus clavatus, Cryptococcus neoformans, Chlamydia trachomatis, Coccidioides immitis, Cryptococcus laurentii, Cryptococcus albidus, Cryptococcus gattii, Nocardia* spp, *Histoplasma capsulatum, Pneumocystis jirovecii* (or *Pneumocystis carinii*), *Stachybotrys chartarum*, and any combination thereof.

Exemplary parasites include, but are not limited to: *Entamoeba histolytica; Plasmodium* species (*Plasmodium falciparum, Plasmodium malariae, Plasmodium ovale, Plasmodium vivax*), *Leishmania* species (*Leishmania tropica, Leishmania braziliensis, Leishmania donovani*), Toxoplasmosis (*Toxoplasma gondii*), *Trypanosoma gambiense, Trypanosoma rhodesiense* (African sleeping sickness), *Trypanosoma cruzi* (Chagas' disease), Helminths (flat worms, round worms), *Babesia microti, Babesia divergens, Giardia lamblia*, and any combination thereof.

The invention further relates to the use of an iRNA targeting one or more EGLN genes and compositions containing at least one such iRNA for the treatment of an infectious disease, such as hepatitis B or a chronic bacterial infection, in combination with other pharmaceuticals and/or other therapeutic methods, e.g., with known pharmaceuticals and/or known therapeutic methods, such as, for example, those which are currently employed for treating such infectious diseases or disorders (e.g., antibiotics, antiviral agents). For example, in certain embodiments, administration of one or more dsRNA targeting EGLN is administered in combination with an antibacterial agent. Examples of anti-bacterial agents useful for the methods described herein include, but are not limited to, natural penicillins, semi-synthetic penicillins, clavulanic acid, cephalolsporins, bacitracin, ampicillin, carbenicillin, oxacillin, azlocillin, mezlocillin, piperacillin, methicillin, dicloxacillin, nafcillin, cephalothin, cephapirin, cephalexin, cefamandole, cefaclor, cefazolin, cefuroxine, cefoxitin, cefotaxime, cefsulodin, cefetamet, cefixime, ceftriaxone, cefoperazone, ceftazidine, moxalactam, carbapenems, imipenems, monobactems, eurtreonam, vancomycin, polymyxin, amphotericin B, nystatin, imidazoles, clotrimazole, miconazole, ketoconazole, itraconazole, fluconazole, rifampins, ethambutol, tetracyclines, chloramphenicol, macrolides, aminoglycosides, streptomycin, kanamycin, tobramycin, amikacin, gentamicin, tetracycline, minocycline, doxycycline, chlortetracycline, erythromycin, roxithromycin, clarithromycin, oleandomycin, azithromycin, chloramphenicol, quinolones, co-trimoxazole, norfloxacin, ciprofloxacin, enoxacin, nalidixic acid, temafloxacin, sulfonamides, gantrisin, and trimethoprim; Acedapsone; Acetosulfone Sodium; Alamecin; Alexidine; Amdinocillin; Amdinocillin Pivoxil; Amicycline; Amifloxacin; Amifloxacin Mesylate; Amikacin; Amikacin Sulfate; Aminosalicylic acid; Aminosalicylate sodium; Amoxicillin; Amphomycin; Ampicillin; Ampicillin Sodium; Apalcillin Sodium; Apramycin; Aspartocin; Astromicin Sulfate; Avilamycin; Avoparcin; Azithromycin; Azlocillin; Azlocillin Sodium; Bacampicillin Hydrochloride; Bacitracin; Bacitracin Methylene Disalicylate; Bacitracin Zinc; Bambermycins; Benzoylpas Calcium; Berythromycin; Betamicin Sulfate; Biapenem; Biniramycin; Biphenamine Hydrochloride; Bispyrithione Magsulfex; Butikacin; Butirosin Sulfate; Capreomycin Sulfate; Carbadox; Carbenicillin Disodium; Carbenicillin Indanyl Sodium; Carbenicillin Phenyl Sodium; Carbenicillin Potassium; Carumonam Sodium; Cefaclor; Cefadroxil; Cefamandole; Cefamandole Nafate; Cefamandole Sodium; Cefaparole; Cefatrizine; Cefazaflur Sodium; Cefazolin; Cefazolin Sodium; Cefbuperazone; Cefdinir; Cefepime; Cefepime Hydrochloride; Cefetecol; Cefixime; Cefmenoxime Hydrochloride; Cefmetazole; Cefmetazole Sodium; Cefonicid Monosodium; Cefonicid Sodium; Cefoperazone Sodium; Ceforanide; Cefotaxime Sodium; Cefotetan; Cefotetan Disodium; Cefotiam Hydrochloride; Cefoxitin; Cefoxitin Sodium; Cefpimizole; Cefpimizole Sodium; Cefpiramide; Cefpiramide Sodium; Cefpirome Sulfate; Cefpodoxime Proxetil; Cefprozil; Cefroxadine; Cefsulodin Sodium; Ceftazidime; Ceftibuten; Ceftizoxime Sodium; Ceftriaxone Sodium; Cefuroxime; Cefuroxime Axetil; Cefuroxime Pivoxetil; Cefuroxime Sodium; Cephacetrile Sodium; Cephalexin; Cephalexin Hydrochloride; Cephaloglycin; Cephaloridine; Cephalothin Sodium; Cephapirin Sodium; Cephradine; Cetocycline Hydrochloride; Cetophenicol; Chloramphenicol; Chloramphenicol Palmitate; Chloramphenicol Pantothenate Complex; Chloramphenicol Sodium Succinate; Chlorhexidine Phosphanilate; Chloroxylenol; Chlortetracycline Bisulfate; Chlortetracycline Hydrochloride; Cinoxacin; Ciprofloxacin; Ciprofloxacin Hydrochloride; Cirolemycin; Clarithromycin; Clinafloxacin Hydrochloride; Clindamycin; Clindamycin Hydrochloride; Clindamycin Palmitate Hydrochloride; Clindamycin Phosphate; Clofazimine; Cloxacillin Benzathine; Cloxacillin Sodium; Cloxyquin; Colistimethate Sodium; Colistin Sulfate; Coumermycin; Coumermycin Sodium; Cyclacillin; Cycloserine; Dalfopristin; Dapsone; Daptomycin; Demeclocycline; Demeclocycline Hydrochloride; Demecycline; Denofungin; Diaveridine; Dicloxacillin; Dicloxacillin Sodium; Dihydrostreptomycin Sulfate; Dipyrithione; Dirithromycin; Doxycycline; Doxycycline Calcium; Doxycycline Fosfatex; Doxycycline Hyclate; Droxacin Sodium; Enoxacin; Epicillin; Epitetracycline Hydrochloride; Erythromycin; Erythromycin Acistrate; Erythromycin Estolate; Erythromycin Ethylsuccinate; Erythromycin Gluceptate; Erythromycin Lactobionate; Erythromycin Propionate; Erythromycin Stearate; Ethambutol Hydrochloride; Ethionamide; Fleroxacin; Floxacillin; Fludalanine; Flumequine; Fosfomycin; Fosfomycin Tromethamine; Fumoxicillin; Furazolium Chloride; Furazolium Tartrate; Fusidate Sodium; Fusidic Acid; Gentamicin Sulfate; Gloximonam; Gramicidin; Haloprogin; Hetacillin; Hetacillin Potassium; Hexedine; Ibafloxacin; Inipenem; Isoconazole; Isepamicin; Isoniazid; Josamycin; Kanamycin Sulfate; Kitasamycin; Levofuraltadone; Levopropylcillin Potassium; Lexithromycin; Lincomycin; Lincomycin Hydrochloride; Lomefloxacin; Lomefloxacin Hydrochloride; Lomefloxacin Mesylate; Loracarbef; Mafenide; Meclocycline; Meclocycline Sulfosalicylate; Megalomicin Potassium Phosphate; Mequidox; Meropenem; Methacycline; Methacycline Hydrochloride; Methenamine; Methenamine Hippurate; Methenamine Mandelate; Methicillin Sodium; Metioprim; Metronidazole Hydrochloride; Metronidazole Phosphate; Mezlocillin; Mezlocillin Sodium; Minocycline; Minocycline Hydrochloride; Mirincamycin Hydrochloride;

Monensin; Monensin Sodium; Nafcillin Sodium; Nalidixate Sodium; Nalidixic Acid; Natamycin; Nebramycin; Neomycin Palmitate; Neomycin Sulfate; Neomycin Undecylenate; Netilmicin Sulfate; Neutramycin; Nifuradene; Nifuraldezone; Nifuratel; Nifuratrone; Nifurdazil; Nifurimide; Nifurpirinol; Nifurquinazol; Nifurthiazole; Nitrocycline; Nitrofurantoin; Nitromide; Norfloxacin; Novobiocin Sodium; Ofloxacin; Ormetoprim; Oxacillin Sodium; Oximonam; Oximonam Sodium; Oxolinic Acid; Oxytetracycline; Oxytetracycline Calcium; Oxytetracycline Hydrochloride; Paldimycin; Parachlorophenol; Paulomycin; Pefloxacin; Pefloxacin Mesylate; Penamecillin; Penicillin G Benzathine; Penicillin G Potassium; Penicillin G Procaine; Penicillin G Sodium; Penicillin V; Penicillin V Benzathine; Penicillin V Hydrabamine; Penicillin V Potassium; Pentizidone Sodium; Phenyl Aminosalicylate; Piperacillin Sodium; Pirbenicillin Sodium; Piridicillin Sodium; Pirlimycin Hydrochloride; Pivampicillin Hydrochloride; Pivampicillin Pamoate; Pivampicillin Probenate; Polymyxin B Sulfate; Porfiromycin; Propikacin; Pyrazinamide; Pyrithione Zinc; Quindecamine Acetate; Quinupristin; Racephenicol; Ramoplanin; Ranimycin; Relomycin; Repromicin; Rifabutin; Rifametane; Rifamexil; Rifamide; Rifampin; Rifapentine; Rifaximin; Rolitetracycline; Rolitetracycline Nitrate; Rosaramicin; Rosaramicin Butyrate; Rosaramicin Propionate; Rosaramicin Sodium Phosphate; Rosaramicin Stearate; Rosoxacin; Roxarsone; Roxithromycin; Sancycline; Sanfetrinem Sodium; Sarmoxicillin; Sarpicillin; Scopafungin; Sisomicin; Sisomicin Sulfate; Sparfloxacin; Spectinomycin Hydrochloride; Spiramycin; Stallimycin Hydrochloride; Steffimycin; Streptomycin Sulfate; Streptonicozid; Sulfabenz; Sulfabenzamide; Sulfacetamide; Sulfacetamide Sodium; Sulfacytine; Sulfadiazine; Sulfadiazine Sodium; Sulfadoxine; Sulfalene; Sulfamerazine; Sulfameter; Sulfamethazine; Sulfamethizole; Sulfamethoxazole; Sulfamonomethoxine; Sulfamoxole; Sulfanilate Zinc; Sulfanitran; Sulfasalazine; Sulfasomizole; Sulfathiazole; Sulfazamet; Sulfisoxazole; Sulfisoxazole Acetyl; Sulfisoxazole Diolamine; Sulfomyxin; Sulopenem; Sultamicillin; Suncillin Sodium; Talampicillin Hydrochloride; Teicoplanin; Temafloxacin Hydrochloride; Temocillin; Tetracycline; Tetracycline Hydrochloride; Tetracycline Phosphate Complex; Tetroxoprim; Thiamphenicol; Thiphencillin Potassium; Ticarcillin Cresyl Sodium; Ticarcillin Disodium; Ticarcillin Monosodium; Ticlatone; Tiodonium Chloride; Tobramycin; Tobramycin Sulfate; Tosufloxacin; Trimethoprim; Trimethoprim Sulfate; Trisulfapyrimidines; Troleandomycin; Trospectomycin Sulfate; Tyrothricin; Vancomycin; Vancomycin Hydrochloride; Virginiamycin; and Zorbamycin.

In other embodiments, administration of one or more dsRNA targeting one or more EGLN genes is performed in combination with an anti-viral medicament or agent. Exemplary antiviral agents useful for the methods described herein include, but are not limited to, immunoglobulins, amantadine, interferon, nucleoside analogues, and protease inhibitors. Specific examples of antiviral agents include but are not limited to Acemannan; Acyclovir; Acyclovir Sodium; Adefovir; Alovudine; Alvircept Sudotox; Amantadine Hydrochloride; Aranotin; Arildone; Atevirdine Mesylate; Avridine; Cidofovir; Cipamfylline; Cytarabine Hydrochloride; Delavirdine Mesylate; Desciclovir; Didanosine; Disoxaril; Edoxudine; Enviradene; Enviroxime; Famciclovir; Famotine Hydrochloride; Fiacitabine; Fialuridine; Fosarilate; Foscarnet Sodium; Fosfonet Sodium; Ganciclovir; Ganciclovir Sodium; Idoxuridine; Kethoxal; Lamivudine; Lobucavir; Memotine Hydrochloride; Methisazone; Nevirapine; Penciclovir; Pirodavir; Ribavirin; Rimantadine Hydrochloride; Saquinavir Mesylate; Somantadine Hydrochloride; Sorivudine; Statolon; Stavudine; Tilorone Hydrochloride; Trifluridine; Valacyclovir Hydrochloride; Vidarabine; Vidarabine Phosphate; Vidarabine Sodium Phosphate; Viroxime; Zalcitabine; Zidovudine; and Zinviroxime.

In other embodiments, administration of one or more dsRNA targeting one or more EGLN genes is performed in combination with an anti-fungal medicament or agent. An "antifungal medicament" is an agent that kills or inhibits the growth or function of infective fungi. Anti-fungal medicaments are sometimes classified by their mechanism of action. Some anti-fungal agents function as cell wall inhibitors by inhibiting glucose synthase, other antifungal agents function by destabilizing membrane integrity, and other antifungal agents function by breaking down chitin (e.g., chitinase) or immunosuppression (501 cream). Thus, exemplary antifungal medicaments useful for the methods described herein include, but are not limited to, imidazoles, 501 cream, and Acrisorcin, Ambruticin, Amorolfine, Amphotericin B, Azaconazole, Azaserine, Basifungin, BAY 38-9502, Bifonazole, Biphenamine Hydrochloride, Bispyrithione Magsulfex, Butenafine, Butoconazole Nitrate, Calcium Undecylenate, Candicidin, Carbol-Fuchsin, Chitinase, Chlordantoin, Ciclopirox, Ciclopirox Olamine, Cilofungin, Cisconazole, Clotrimazole, Cuprimyxin, Denofungin, Dipyrithione, Doconazole, Econazole, Econazole Nitrate, Enilconazole, Ethonam Nitrate, Fenticonazole Nitrate, Filipin, FK 463, Fluconazole, Flucytosine, Fungimycin, Griseofulvin, Hamycin, Isoconazole, Itraconazole, Kalafungin, Ketoconazole, Lomofungin, Lydimycin, Mepartricin, Miconazole, Miconazole Nitrate, MK 991, Monensin, Monensin Sodium, Naftifine Hydrochloride, Neomycin Undecylenate, Nifuratel, Nifurmerone, Nitralamine Hydrochloride, Nystatin, Octanoic Acid, Orconazole Nitrate, Oxiconazole Nitrate, Oxifungin Hydrochloride, Parconazole Hydrochloride, Partricin, Potassium Iodide, Pradimicin, Proclonol, Pyrithione Zinc, Pyrrolnitrin, Rutamycin, Sanguinarium Chloride, Saperconazole, Scopafungin, Selenium Sulfide, Sertaconazole, Sinefungin, Sulconazole Nitrate, Terbinafine, Terconazole, Thiram, Ticlatone, Tioconazole, Tolciclate, Tolindate, Tolnaftate, Triacetin, Triafungin, UK 292, Undecylenic Acid, Viridofulvin, Voriconazole, Zinc Undecylenate, and Zinoconazole Hydrochloride.

In further embodiments, administration of one or more dsRNA targeting one or more EGLN genes is administered in combination with an anti-parasitic medicament or agent. An "antiparasitic medicament" refers to an agent that kills or inhibits the growth or function of infective parasites. Examples of antiparasitic medicaments, also referred to as parasiticides, useful for the methods described herein include, but are not limited to, albendazole, amphotericin B, benznidazole, bithionol, chloroquine HCl, chloroquine phosphate, clindamycin, dehydroemetine, diethylcarbamazine, diloxanide furoate, doxycycline, eflomithine, furazolidaone, glucocorticoids, halofantrine, iodoquinol, ivermectin, mebendazole, mefloquine, meglumine antimoniate, melarsoprol, metrifonate, metronidazole, niclosamide, nifurtimox, oxamniquine, paromomycin, pentamidine isethionate, piperazine, praziquantel, primaquine phosphate, proguanil, pyrantel pamoate, pyrimethanmine-sulfonamides, pyrimethanmine-sulfadoxine, quinacrine HCl, quinine sulfate, quinidine gluconate, spiramycin, stibogluconate sodium (sodium antimony gluconate), suramin, tetracycline, thiabendazole, timidazole, trimethroprim-sulfamethoxazole, and tryparsamide, some of which are used alone or in combination with others.

The iRNA and an additional therapeutic agent can be administered in combination in the same composition, e.g., parenterally, or the additional therapeutic agent can be administered as part of a separate composition or by another method described herein.

Patients can be administered a therapeutic amount of iRNA, such as 0.5 mg/kg, 1.0 mg/kg, 1.5 mg/kg, 2.0 mg/kg, or 2.5 mg/kg dsRNA. The iRNA can be administered by intravenous infusion over a period of time, such as over a 5 minute, 10 minute, 15 minute, 20 minute, or 25 minute period. The administration is repeated, for example, on a regular basis, such as biweekly (i.e., every two weeks) for one month, two months, three months, four months or longer. After an initial treatment regimen, the treatments can be administered on a less frequent basis. For example, after administration biweekly for three months, administration can be repeated once per month, for six months or a year or longer. Administration of the iRNA can reduce EGLN levels, e.g., in a cell, tissue, blood, urine or other compartment of the patient by at least 10%, at least 15%, at least 20%, at least 25%, at least 30%, at least 40%, at least 50%, at least 60%, at least 70%, at least 80% or at least 90% or more.

Before administration of a full dose of the iRNA, patients can be administered a smaller dose, such as a 5% infusion reaction, and monitored for adverse effects, such as an allergic reaction, or for elevated lipid levels or blood pressure. In another example, the patient can be monitored for unwanted immunostimulatory effects, such as increased cytokine (e.g., TNF-alpha or INF-alpha) levels.

Genetic predisposition plays a role in the development of some cancers and hematological malignancies. Therefore, a patient in need of one or more EGLN iRNA may be identified by taking a family history, or, for example, screening for one or more genetic markers or variants. A healthcare provider, such as a doctor, nurse, or family member, can take a family history before prescribing or administering an EGLN dsRNA. For example, certain variants in the BRCA1 and BRCA2 genes are known to cause an increased risk for breast and ovarian cancers. A DNA test may also be performed on the patient to identify a mutation in an EGLN gene, before an EGLN dsRNA is administered to the patient.

Owing to the inhibitory effects on EGLN expression, a composition according to the invention or a pharmaceutical composition prepared therefrom can enhance the quality of life.

Methods for Modulating Expression of an EGLN Gene

In yet another aspect, the invention provides a method for modulating (e.g., inhibiting or activating) the expression of an EGLN gene in a mammal.

In one embodiment, the method includes administering a composition featured in the invention to the mammal such that expression of the target EGLN gene is decreased, such as for an extended duration, e.g., at least two, three, four days or more, e.g., one week, two weeks, three weeks, or four weeks or longer.

In another embodiment, the method includes administering a composition as described herein to a mammal such that expression of the target EGLN gene is increased by e.g., at least 10% compared to an untreated animal. In some embodiments, the activation of EGLN occurs over an extended duration, e.g., at least two, three, four days or more, e.g., one week, two weeks, three weeks, four weeks, or more. Without wishing to be bound by theory, an iRNA can activate EGLN expression by stabilizing an EGLN mRNA transcript, interacting with a promoter in the genome, and/or inhibiting an inhibitor of EGLN expression.

Preferably, the iRNAs useful for the methods and compositions featured in the invention specifically target RNAs (primary or processed) of the target EGLN gene. Compositions and methods for inhibiting the expression of these EGLN genes using iRNAs can be prepared and performed as described elsewhere herein.

In one embodiment, the method includes administering a composition containing an iRNA, where the iRNA includes a nucleotide sequence that is complementary to at least a part of an RNA transcript of an EGLN gene of the mammal to be treated. When the organism to be treated is a mammal such as a human, the composition may be administered by any means known in the art including, but not limited to oral, intraperitoneal, or parenteral routes, including intracranial (e.g., intraventricular, intraparenchymal and intrathecal), intravenous, intramuscular, subcutaneous, transdermal, airway (aerosol), nasal, rectal, and topical (including buccal and sublingual) administration. In certain embodiments, the compositions are administered by intravenous infusion or injection.

In one embodiment iRNAs are able to substantially target a single organ of the body. The targeted organ may be, but is not limited to, the liver, kidney and spleen. In another embodiment, the organ substantially targeted is the liver.

Unless otherwise defined, all technical and scientific terms used herein have the same meaning as commonly understood by one of ordinary skill in the art to which this invention belongs. Although methods and materials similar or equivalent to those described herein can be used in the practice or testing of the iRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1. iRNA Synthesis

Source of Reagents

Where the source of a reagent is not specifically given herein, such reagent may be obtained from any supplier of reagents for molecular biology at a quality/purity standard for application in molecular biology.

Oligonucleotide Synthesis.

All oligonucleotides are synthesized on an AKTAoligopilot synthesizer. Commercially available controlled pore glass solid support (dT-CPG, 500 Å, Prime Synthesis) and RNA phosphoramidites with standard protecting groups, 5'-O-dimethoxytrityl N6-benzoyl-2'-t-butyldimethylsilyl-adenosine-3'-O—N,N'-diisopropyl-2-cyanoethylphosphoramidite, 5'-O-dimethoxytrityl-N4-acetyl-2'-t-butyldimethyl-silyl-cytidine-3'-O—N,N'-diisopropyl-2-cyanoethylphosphoramidite, 5'-O-dimethoxytrityl-N2-isobutryl-2'-t-butyldimethylsilyl-guanosine-3'-O—N,N'-diisopropyl-2-cyanoethylphosphoramidite, and 5'-O-dimethoxytrityl-2'-t-butyldimethylsilyl-uridine-3'-O—N,N'-diisopropyl-2-cyanoethylphosphoramidite (Pierce Nucleic Acids Technologies) were used for the oligonucleotide synthesis. The 2'-F phosphoramidites, 5'-O-dimethoxytrityl-N4-acetyl-2'-fluro-cytidine-3'-O—N,N'-diisopropyl-2-cyano-ethyl-phosphoramidite and 5'-O-dimethoxytrityl-2'-fluro-uridine-3'-O—N,N'-diisopropyl-2-cyanoethyl-phosphoramidite are purchased from (Promega). All phosphoramidites are used at a concentration of 0.2M in acetonitrile (CH$_3$CN) except for guanosine which is used at 0.2M concentration in 10% THF/ANC (v/v). Coupling/recycling time of 16 minutes is used. The activator is 5-ethyl thiotetrazole (0.75M, American International Chemicals); for the PO-oxidation iodine/water/pyridine is used and for the PS-oxidation PADS (2%) in 2,6-lutidine/ACN (1:1 v/v) is used.

3'-ligand conjugated strands are synthesized using solid support containing the corresponding ligand. For example, the introduction of cholesterol unit in the sequence is performed from a hydroxyprolinol-cholesterol phosphoramidite. Cholesterol is tethered to trans-4-hydroxyprolinol via a 6-aminohexanoate linkage to obtain a hydroxyprolinol-cholesterol moiety. 5'-end Cy-3 and Cy-5.5 (fluorophore) labeled iRNAs are synthesized from the corresponding Quasar-570 (Cy-3) phosphoramidite are purchased from Biosearch Technologies. Conjugation of ligands to 5'-end and or internal position is achieved by using appropriately protected ligand-phosphoramidite building block. An extended 15 min coupling of 0.1 M solution of phosphoramidite in anhydrous CH$_3$CN in the presence of 5-(ethylthio)-1H-tetrazole activator to a solid-support-bound oligonucleotide. Oxidation of the internucleotide phosphite to the phosphate is carried out using standard iodine-water as reported (1) or by treatment with tert-butyl hydroperoxide/acetonitrile/water (10:87:3) with 10 min oxidation wait time conjugated oligonucleotide. Phosphorothioate is introduced by the oxidation of phosphite to phosphorothioate by using a sulfur transfer reagent such as DDTT (purchased from AM Chemicals), PADS and or Beaucage reagent. The cholesterol phosphoramidite is synthesized in house and used at a concentration of 0.1 M in dichloromethane. Coupling time for the cholesterol phosphoramidite is 16 minutes.

Deprotection I (Nucleobase Deprotection)

After completion of synthesis, the support is transferred to a 100 mL glass bottle (VWR). The oligonucleotide is cleaved from the support with simultaneous deprotection of base and phosphate groups with 80 mL of a mixture of ethanolic ammonia [ammonia: ethanol (3:1)] for 6.5 h at 55° C. The bottle is cooled briefly on ice and then the ethanolic ammonia mixture is filtered into a new 250-mL bottle. The CPG is washed with 2×40 mL portions of ethanol/water (1:1 v/v). The volume of the mixture is then reduced to ~30 mL by roto-vap. The mixture is then frozen on dry ice and dried under vacuum on a speed vac.

Deprotection II (Removal of 2'-TBDMS Group)

The dried residue is resuspended in 26 mL of triethylamine, triethylamine trihydrofluoride (TEA.3HF) or pyridine-HF and DMSO (3:4:6) and heated at 60° C. for 90 minutes to remove the tert-butyldimethylsilyl (TBDMS) groups at the 2' position. The reaction is then quenched with 50 mL of 20 mM sodium acetate and the pH is adjusted to 6.5. Oligonucleotide is stored in a freezer until purification.

Analysis

The oligonucleotides are analyzed by high-performance liquid chromatography (HPLC) prior to purification and selection of buffer and column depends on nature of the sequence and or conjugated ligand.

HPLC Purification

The ligand-conjugated oligonucleotides are purified by reverse-phase preparative HPLC. The unconjugated oligonucleotides are purified by anion-exchange HPLC on a TSK gel column packed in house. The buffers are 20 mM sodium phosphate (pH 8.5) in 10% CH$_3$CN (buffer A) and 20 mM sodium phosphate (pH 8.5) in 10% CH$_3$CN, 1M NaBr (buffer B). Fractions containing full-length oligonucleotides are pooled, desalted, and lyophilized. Approximately 0.15 OD of desalted oligonucleotides are diluted in water to 150 µL and then pipetted into special vials for CGE and LC/MS analysis. Compounds are then analyzed by LC-ESMS and CGE.

iRNA Preparation

For the general preparation of iRNA, equimolar amounts of sense and antisense strand are heated in 1×PBS at 95° C. for 5 min and slowly cooled to room temperature. Integrity of the duplex is confirmed by HPLC analysis.

Nucleic acid sequences are represented below using standard nomenclature, and specifically the abbreviations of Table 1.

TABLE 1

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
| --- | --- |
| A | Adenosine |
| C | Cytidine |
| G | Guanosine |
| T | Thymidine |
| U | Uridine |
| N | any nucleotide (G, A, C, T or U) |
| a | 2'-O-methyladenosine |
| c | 2'-O-methylcytidine |
| g | 2'-O-methylguanosine |
| u | 2'-O-methyluridine |
| dT | 2'-deoxythymidine |
| s | phosphorothioate linkage |

Example 2. EGLN siRNA Design and Synthesis Transcripts

Oligonucleotide design was carried out to identify siRNAs targeting the genes encoding the mouse (*Mus musculus*) EGLN 1, 2 and 3 genes. The design process used the EGLN transcript NM_053207.2 for EGLN1 (SEQ ID NO: 5), NM_053208.4 for EGLN2 (SEQ ID NO: 6), and NM_028133.2 for EGLN3 (SEQ ID NO: 7). All sequences were obtained from the NCBI Refseq collection.

The orthologous sequences from humans (*Homo sapiens*) were also designed. Oligonucleotide design was carried out to identify siRNAs targeting the genes encoding the human (*Homo sapiens*) EGLN 1, 2 and 3 genes. The design process used the EGLN transcript NM_022051.2 for EGLN1 (SEQ ID NO: 390), NM_053046.2 for EGLN2 (SEQ ID NO: 391), and NM_022073.3 for EGLN3 (SEQ ID NO: 392). All sequences were obtained from the NCBI Refseq collection.

The set of mouse EGLN derived siRNA oligos designed and synthesized are presented in Tables 2A-F.

The set of human EGLN derived siRNA oligonucleotide single and double strand duplexes designed are presented in Tables 6A-C.

siRNA Design and Specificity Prediction

The specificity of the 19mer oligo sets was predicted from each sequence. The EGLN siRNAs were used in a comprehensive search against their respective human, or mouse and rat transcriptomes (defined as the set of NM_ and XM_records within the NCBI Refseq set) using the FASTA algorithm. The Python script 'offtargetFasta.py' was then used to parse the alignments and generate a score based on the position and number of mismatches between the siRNA and any potential 'off-target' transcript. The off-target score is weighted to emphasize differences in the 'seed' region of siRNAs, in positions 2-9 from the 5' end of the molecule. The off-target score is calculated as follows: mismatches between the oligo and the transcript are given penalties. A mismatch in the seed region in positions 2-9 of the oligo is given a penalty of 2.8; mismatches in the putative cleavage sites 10 and 11 are given a penalty of 1.2, and all other mismatches a penalty of 1. The off-target score for each oligo-transcript pair is then calculated by summing the mismatch penalties. The lowest off-target score from all the oligo-transcript pairs is then determined and used in subsequent sorting of oligos. Both siRNAs strands were assigned to a category of specificity according to the calculated scores: a score above 3 qualifies as highly specific, equal to 3 as specific and between 2.2 and 2.8 as moderate specific. In picking which oligos to synthesize, we sorted from high to low by the off-target score of the antisense strand and took the best (lowest off-target score) oligo pairs.

Synthesis of EGLN Sequences

EGLN targeting sequences were synthesized on a MerMade 192 synthesizer at 1 μmol scale.

For all chemically modified sequences in the list, 'endo-light' chemistry was applied as detailed below.

All pyrimidines (cytosine and uridine) in the sense strand contained 2'-O-Methyl bases (2' O-Methyl C and 2'-O-Methyl U)
   In the antisense strand, pyrimidines adjacent to (towards 5' position) ribo A nucleoside were replaced with their corresponding 2-O-Methyl nucleosides
   A two base dTsdT extension at 3' end of both sense and antisense sequences was introduced
   The sequence file was converted to a text file to make it compatible for loading in the MerMade 192 synthesis software Synthesis, Cleavage and Deprotection:

The synthesis of EGLN sequences used solid supported oligonucleotide synthesis using phosphoramidite chemistry.

The synthesis of the above sequences was performed at 1 um scale in 96 well plates. The amidite solutions were prepared at 0.1M concentration and ethyl thio tetrazole (0.6M in Acetonitrile) was used as activator.

The synthesized sequences were cleaved and deprotected in 96 well plates, using methylamine in the first step and fluoride reagent in the second step. The crude sequences were precipitated using acetone:ethanol (80:20) mix and the pellet were resuspended in 0.02M sodium acetate buffer. Samples from each sequence were analyzed by LC-MS to confirm the identity, UV for quantification and a selected set of samples by IEX chromatography to determine purity.

Purification and Desalting:

EGLN sequences were purified on AKTA explorer purification system using Source 15Q column. A column temperature of 65 C was maintained during purification. Sample injection and collection was performed in 96 well (1.8 mL-deep well) plates. A single peak corresponding to the full length sequence was collected in the eluent. The purified sequences were desalted on a Sephadex G25 column using AKTA purifier. The desalted EGLN sequences were analyzed for concentration (by UV measurement at A260) and purity (by ion exchange HPLC). The single strands were then submitted for annealing. The control duplex, AD-1955, which targets the luciferase gene has the sense sequence cuuAcGcuGAGuAcuucGAdTsdT (SEQ ID NO: 8) and the antisense sequence UCGAAGuACUcAGCGuAAGdTsdT (SEQ ID NO: 9), where lower case nucleotides are modified by 2'Omethyl and dT stands for deoxyThymidine and "s" represents a phosphorothioate linkage.

TABLE 2A

Mouse EGNL1 Single Strands and Duplex Sequences

| Duplex Number | Start* | Sequence (5' to 3') Sense | SEQ ID NO. | Sequence (5' to 3') Antisense | SEQ ID NO. |
|---|---|---|---|---|---|
| AD-40893 | 1057 | GCUAUGUCCGUCACGUUGA | 10 | UCAACGUGACGGACAUAGC | 11 |
| AD-40899 | 1065 | CGUCACGUUGAUAACCCAA | 12 | UUGGGUUAUCAACGUGACG | 13 |
| AD-40905 | 1092 | GGAAGAUGCGUGACAUGUA | 14 | UACAUGUCACGCAUCUUCC | 15 |
| AD-40911 | 1128 | GACUGGGACGCCAAGGUAA | 16 | UUACCUUGGCGUCCCAGUC | 17 |
| AD-40917 | 1150 | GAGGUAUUCUUCGAAUUUU | 18 | AAAAUUCGAAGAAUACCUC | 19 |
| AD-40923 | 1240 | GGCGUAACCCUCAUGAAGU | 20 | ACUUCAUGAGGGUUACGCC | 21 |
| AD-40929 | 1271 | CGCCACAAGGUACGCAAUA | 22 | UAUUGCGUACCUUGUGGCG | 23 |
| AD-40888 | 1272 | GCCACAAGGUACGCAAUAA | 24 | UUAUUGCGUACCUUGUGGC | 25 |
| AD-40894 | 1276 | CAAGGUACGCAAUAACUGU | 26 | ACAGUUAUUGCGUACCUUG | 27 |
| AD-40900 | 1317 | CGAGCGAGAGCUAAAGUAA | 28 | UUACUUUAGCUCUCGCUCG | 29 |
| AD-40906 | 1320 | GCGAGAGCUAAAGUAAAAU | 30 | AUUUUACUUUAGCUCUCGC | 31 |
| AD-40912 | 1356 | GGUGUGAGGGUUGAACUCA | 32 | UGAGUUCAACCCUCACACC | 33 |
| AD-40918 | 1386 | GUCAGCAAAGACGUCUAGU | 34 | ACUAGACGUCUUUGCUGAC | 35 |
| AD-40924 | 1892 | GCCUCCUGCGAUGAUUGUU | 36 | AACAAUCAUCGCAGGAGGC | 37 |
| AD-40930 | 1919 | GUGACGACGUGUUGCUUCU | 38 | AGAAGCAACACGUCGUCAC | 39 |
| AD-40889 | 2043 | CGCUUCGACCGACCUAACA | 40 | UGUUAGGUCGGUCGAAGCG | 41 |

TABLE 2A-continued

Mouse EGNL1 Single Strands and Duplex Sequences

| Duplex Number | Start* | Sequence (5' to 3') Sense | SEQ ID NO. | Sequence (5' to 3') Antisense | SEQ ID NO. |
|---|---|---|---|---|---|
| AD-40895 | 2048 | CGACCGACCUAACAGUAGA | 42 | UCUACUGUUAGGUCGGUCG | 43 |
| AD-40901 | 2093 | CAACAUAGUUACAAGAGGA | 44 | UCCUCUUGUAACUAUGUUG | 45 |
| AD-40907 | 2159 | CGAAGUGACGGGCACUAAA | 46 | UUUAGUGCCCGUCACUUCG | 47 |
| AD-40913 | 2160 | GAAGUGACGGGCACUAAAU | 48 | AUUUAGUGCCCGUCACUUC | 49 |
| AD-40919 | 2372 | GUGAAUGUGGUAUGUGGUU | 50 | AACCACAUACCACAUUCAC | 51 |
| AD-40925 | 2605 | GCACAGAUUGUGGGUAUAA | 52 | UUAUACCCACAAUCUGUGC | 53 |
| AD-40931 | 2624 | CUCCUGUCCCCUUAGGUGU | 54 | ACACCUAAGGGGACAGGAG | 55 |
| AD-40890 | 2732 | GUUUGUAUCCGGUUAGAAA | 56 | UUUCUAACCGGAUACAAAC | 57 |
| AD-40896 | 2889 | GUCUCCUUCUGACCCAUAU | 58 | AUAUGGGUCAGAAGGAGAC | 59 |
| AD-40902 | 2894 | CUUCUGACCCAUAUCCGCU | 60 | AGCGGAUAUGGGUCAGAAG | 61 |
| AD-40908 | 3001 | GGAACUGUUUGGCAUUGUU | 62 | AACAAUGCCAAACAGUUCC | 63 |
| AD-40914 | 3244 | CUUAAUGCCCACUUAAACU | 64 | AGUUUAAGUGGGCAUUAAG | 65 |
| AD-40920 | 3272 | GUUAGGACUCUUGUUUAAA | 66 | UUUAAACAAGAGUCCUAAC | 67 |
| AD-40926 | 3350 | CUGUUCAACACAUUAACCA | 68 | UGGUUAAUGUGUUGAACAG | 69 |
| AD-40932 | 3472 | GCUUGUAAAGCUAAUCUAA | 70 | UUAGAUUAGCUUUACAAGC | 71 |

*Start is the 5' most position on transcript NM_053207.2

TABLE 2B

Mouse EGNL1 Chemically modified Single Strands and Duplex Sequences
For all the sequences in the list, 'endolight' chemistry was applied as described above.

| Duplex Number | Start* | Sequence (5' to 3') Sense | SEQ ID NO. | Sequence (5' to 3') Antisense | SEQ ID NO. |
|---|---|---|---|---|---|
| AD-40893 | 1057 | GcuAuGuccGucAcGuuGAdTsdT | 72 | UcAACGUGACGGAcAuAGCdTsdT | 73 |
| AD-40899 | 1065 | cGucAcGuuGAuAAcccAAdTsdT | 74 | UUGGGUuAUcAACGUGACGdTsdT | 75 |
| AD-40905 | 1092 | GGAAGAuGcGuGAcAuGuAdTsdT | 76 | uAcAUGUcACGcAUCUUCCdTsdT | 77 |
| AD-40911 | 1128 | GAcuGGGAcGccAAGGuAAdTsdT | 78 | UuACCUUGGCGUCCcAGUCdTsdT | 79 |
| AD-40917 | 1150 | GAGGuAuucuucGAAuuuudTsdT | 80 | AAAAUUCGAAGAAuACCUCdTsdT | 81 |
| AD-40923 | 1240 | GGcGuAAcccucAuGAAGudTsdT | 82 | ACUUcAUGAGGGUuACGCCdTsdT | 83 |
| AD-40929 | 1271 | cGccAcAAGGuAcGcAAuAdTsdT | 84 | uAUUGCGuACCUUGUGGCGdTsdT | 85 |
| AD-40888 | 1272 | GccAcAAGGuAcGcAAuAAdTsdT | 86 | UuAUUGCGuACCUUGUGGCdTsdT | 87 |
| AD-40894 | 1276 | cAAGGuAcGcAAuAAcuGudTsdT | 88 | AcAGUuAUUGCGuACCUUGdTsdT | 89 |
| AD-40900 | 1317 | cGAGcGAGAGcuAAAGuAAdTsdT | 90 | UuACUUuAGCUCUCGCUCGdTsdT | 91 |
| AD-40906 | 1320 | GcGAGAGcuAAAGuAAAAudTsdT | 92 | AUUUuACUUuAGCUCUCGCdTsdT | 93 |
| AD-40912 | 1356 | GGuGuGAGGGuuGAAcucAdTsdT | 94 | UGAGUUcAACCCUcAcACCdTsdT | 95 |
| AD-40918 | 1386 | GucAGcAAAGAcGucuAGudTsdT | 96 | ACuAGACGUCUUUGCUGACdTsdT | 97 |
| AD-40924 | 1892 | GccuccuGcGAuGAuuGuudTsdT | 98 | AAcAAUcAUCGcAGGAGGCdTsdT | 99 |

TABLE 2B-continued

Mouse EGNL1 Chemically modified Single Strands and Duplex Sequences
For all the sequences in the list, 'endolight' chemistry was applied as described above.

| Duplex Number | Start* | Sequence (5' to 3') Sense | SEQ ID NO. | Sequence (5' to 3') Antisense | SEQ ID NO. |
|---|---|---|---|---|---|
| AD-40930 | 1919 | GuGAcGAcGuGuuGcuucudTsdT | 100 | AGAAGcAAcACGUCGUcACdTsdT | 101 |
| AD-40889 | 2043 | cGcuucGAccGAccuAAcAdTsdT | 102 | UGUuAGGUCGGUCGAAGCGdTsdT | 103 |
| AD-40895 | 2048 | cGAccGAccuAAcAGuAGAdTsdT | 104 | UCuACUGUuAGGUCGGUCGdTsdT | 105 |
| AD-40901 | 2093 | cAAcAuAGuuAcAAGAGGAdTsdT | 106 | UCCUCUUGuAACuAUGUUGdTsdT | 107 |
| AD-40907 | 2159 | cGAAGuGAcGGGcAcuAAAdTsdT | 108 | UUuAGUGCCCGUcACUUCGdTsdT | 109 |
| AD-40913 | 2160 | GAAGuGAcGGGcAcuAAAudTsdT | 110 | AUUuAGUGCCCGUcACUUCdTsdT | 111 |
| AD-40919 | 2372 | GuGAAuGuGGuAuGuGGuudTsdT | 112 | AACcAcAuACcAcAUUcACdTsdT | 113 |
| AD-40925 | 2605 | GcAcAGAuuGuGGGuAuAAdTsdT | 114 | UuAuACCcAcAAUCUGUGCdTsdT | 115 |
| AD-40931 | 2624 | cuccuGuccccuuAGGuGudTsdT | 116 | AcACCuAAGGGGAcAGGAGdTsdT | 117 |
| AD-40890 | 2732 | GuuuGuAuccGGuuAGAAAdTsdT | 118 | UUUCuAACCGGAuAcAAAdTsdT | 119 |
| AD-40896 | 2889 | GucuccuucuGAcccAuAudTsdT | 120 | AuAUGGGUcAGAAGGAGACdTsdT | 121 |
| AD-40902 | 2894 | cuucuGAcccAuAuccGcudTsdT | 122 | AGCGGAuAUGGGUcAGAAGdTsdT | 123 |
| AD-40908 | 3001 | GGAAcuGuuuGGcAuuGuudTsdT | 124 | AAcAAUGCcAAAcAGUUCCdTsdT | 125 |
| AD-40914 | 3244 | cuuAAuGcccAcuuAAAcudTsdT | 126 | AGUUuAAGUGGGcAUuAAGdTsdT | 127 |
| AD-40920 | 3272 | GuuAGGAcucuuGuuuAAAdTsdT | 128 | UUuAAAcAAGAGUCCuAACdTsdT | 129 |
| AD-40926 | 3350 | cuGuucAAcAcAuuAAccAdTsdT | 130 | UGGUuAAUGUGUUGAAcAGdTsdT | 131 |
| AD-40932 | 3472 | GcuuGuAAAGcuAAucuAAdTsdT | 132 | UuAGAUuAGCUUuAcAAGCdTsdT | 133 |

TABLE 2C

Mouse EGNL2 Single Strands and Duplex Sequences

| Duplex Number | Start* | Sequence (5' to 3') Sense | SEQ ID NO. | Sequence (5' to 3') Antisense | SEQ ID NO. |
|---|---|---|---|---|---|
| AD-40891 | 128 | AUCAGUCCCUUCUCAAGCU | 134 | AGCUUGAGAAGGGACUGAU | 135 |
| AD-40897 | 418 | GUCCUUGGAGUCUAGCCGA | 136 | UCGGCUAGACUCCAAGGAC | 137 |
| AD-40903 | 545 | GCCACUGCUACUACGACCA | 138 | UGGUCGUAGUAGCAGUGGC | 139 |
| AD-40909 | 934 | GCCUUGCAUGCGGUACUAU | 140 | AUAGUACCGCAUGCAAGGC | 141 |
| AD-40915 | 941 | AUGCGGUACUAUGGUAUCU | 142 | AGAUACCAUAGUACCGCAU | 143 |
| AD-40921 | 943 | GCGGUACUAUGGUAUCUGU | 144 | ACAGAUACCAUAGUACCGC | 145 |
| AD-40927 | 956 | AUCUGUGUCAAGGACAACU | 146 | AGUUGUCCUUGACACAGAU | 147 |
| AD-40933 | 1043 | CGUGAUGGGCAACUAGUGA | 148 | UCACUAGUUGCCCAUCACG | 149 |
| AD-40892 | 1107 | CCUGGGUAGAAGGUCACGA | 150 | UCGUGACCUUCUACCCAGG | 151 |

TABLE 2C-continued

Mouse EGNL2 Single Strands and Duplex Sequences

| Duplex Number | Start* | Sequence (5' to 3') Sense | SEQ ID NO. | Sequence (5' to 3') Antisense | SEQ ID NO. |
|---|---|---|---|---|---|
| AD-40898 | 1158 | CUCACGUGGACGCAGUAAU | 152 | AUUACUGCGUCCACGUGAG | 153 |
| AD-40904 | 1228 | GGCCAUGGUGGCGUGUUAU | 154 | AUAACACGCCACCAUGGCC | 155 |
| AD-40910 | 1235 | GUGGCGUGUUAUCCAGGCA | 156 | UGCCUGGAUAACACGCCAC | 157 |
| AD-40916 | 1253 | AAUGGGCUCGGGUACGUGA | 158 | UCACGUACCCGAGCCCAUU | 159 |
| AD-40922 | 1261 | CGGGUACGUGAGGCAUGUU | 160 | AACAUGCCUCACGUACCCG | 161 |
| AD-40928 | 1263 | GGUACGUGAGGCAUGUUGA | 162 | UCAACAUGCCUCACGUACC | 163 |
| AD-40934 | 1272 | GGCAUGUUGACAAUCCCCA | 164 | UGGGGAUUGUCAACAUGCC | 165 |
| AD-40743 | 1305 | GCAUCACCUGUAUCUAUUA | 166 | UAAUAGAUACAGGUGAUGC | 167 |
| AD-40749 | 1329 | AUCAGAACUGGGAUGUUAA | 168 | UUAACAUCCCAGUUCUGAU | 169 |
| AD-40755 | 1335 | ACUGGGAUGUUAAGGUGCA | 170 | UGCACCUUAACAUCCCAGU | 171 |
| AD-40761 | 1399 | CAACAUCGAGCCACUCUUU | 172 | AAAGAGUGGCUCGAUGUUG | 173 |
| AD-40767 | 1534 | CAGAGACAAGUAUCAGCUA | 174 | UAGCUGAUACUUGUCUCUG | 175 |
| AD-40773 | 1537 | AGACAAGUAUCAGCUAGCA | 176 | UGCUAGCUGAUACUUGUCU | 177 |
| AD-40779 | 1555 | AUCGGGACAGAAAGGUGUU | 178 | AACACCUUUCUGUCCCGAU | 179 |
| AD-40785 | 1567 | AGGUGUUCAAGUACCAGUA | 180 | UACUGGUACUUGAACACCU | 181 |
| AD-40744 | 1708 | GUGGUGUGGAGGGCACUAA | 182 | UUAGUGCCCUCCACACCAC | 183 |
| AD-40750 | 1710 | GGUGUGGAGGGCACUAAGU | 184 | ACUUAGUGCCCUCCACACC | 185 |
| AD-40756 | 1711 | GUGUGGAGGGCACUAAGUA | 186 | UACUUAGUGCCCUCCACAC | 187 |
| AD-40762 | 1830 | UGGCUGUGUCUGGUCCGUU | 188 | AACGGACCAGACACAGCCA | 189 |
| AD-40768 | 1872 | GGAUUUGGGGUUGAGGUGA | 190 | UCACCUCAACCCCAAAUCC | 191 |
| AD-40774 | 1876 | UUGGGGUUGAGGUGAGUCA | 192 | UGACUCACCUCAACCCCAA | 193 |
| AD-40780 | 1917 | GUUGGGGUGUGGGUGUCAU | 194 | AUGACACCCACACCCCAAC | 195 |
| AD-40786 | 2038 | AGGGUGCCAUGACGAGCAU | 196 | AUGCUCGUCAUGGCACCCU | 197 |

*Start is the 5' most position on transcript NM_053208.4

TABLE 2D

Mouse EGNL2 Chemically modified Single Strands and Duplex Sequences
For all the sequences in the list, 'endolight' chemistry was applied as described above.

| Duplex Number | Start* | Sequence (5' to 3') Sense | SEQ ID NO. | Sequence (5' to 3') Antisense | SEQ ID NO. |
|---|---|---|---|---|---|
| AD-40891 | 128 | AucAGucccuucucAAGcudTsdT | 198 | AGCUUGAGAAGGGACUGAUdTsdT | 199 |
| AD-40897 | 418 | GuccuuGGAGucuAGccGAdTsdT | 200 | UCGGCuAGACUCcAAGGACdTsdT | 201 |
| AD-40903 | 545 | GccAcuGcuAcuAcGAccAdTsdT | 202 | UGGUCGuAGuAGcAGUGGCdTsdT | 203 |
| AD-40909 | 934 | GccuuGcAuGcGGuAcuAudTsdT | 204 | AuAGuACCGcAUGcAAGGCdTsdT | 205 |
| AD-40915 | 941 | AuGcGGuAcuAuGGuAucudTsdT | 206 | AGAuACcAuAGuACCGcAUdTsdT | 207 |
| AD-40921 | 943 | GcGGuAcuAuGGuAucuGudTsdT | 208 | AcAGAuACcAuAGuACCGCdTsdT | 209 |
| AD-40927 | 956 | AucuGuGucAAGGAcAAcudTsdT | 210 | AGUUGUCCUUGAcAcAGAUdTsdT | 211 |
| AD-40933 | 1043 | cGuGAuGGGcAAcuAGuGAdTsdT | 212 | UcACuAGUUGCCcAUcACGdTsdT | 213 |
| AD-40892 | 1107 | ccuGGGuAGAAGGucAcGAdTsdT | 214 | UCGUGACCUUCuACCcAGGdTsdT | 215 |
| AD-40898 | 1158 | cucAcGuGGAcGcAGuAAudTsdT | 216 | AUuACUGCGUCcACGUGAGdTsdT | 217 |
| AD-40904 | 1228 | GGccAuGGuGGcGuGuuAudTsdT | 218 | AuAAcACGCcACcAUGGCCdTsdT | 219 |
| AD-40910 | 1235 | GuGGcGuGuuAuccAGGcAdTsdT | 220 | UGCCUGGAuAAcACGCcACdTsdT | 221 |
| AD-40916 | 1253 | AAuGGGcucGGGuAcGuGAdTsdT | 222 | UcACGuACCCGAGCCcAUUdTsdT | 223 |
| AD-40922 | 1261 | cGGGuAcGuGAGGcAuGuudTsdT | 224 | AAcAUGCCUcACGuACCCGdTsdT | 225 |
| AD-40928 | 1263 | GGuAcGuGAGGcAuGuuGAdTsdT | 226 | UcAAcAUGCCUcACGuACCdTsdT | 227 |
| AD-40934 | 1272 | GGcAuGuuGAcAAuccccAdTsdT | 228 | UGGGGAUUGUcAAcAUGCCdTsdT | 229 |
| AD-40743 | 1305 | GcAucAccuGuAucuAuuAdTsdT | 230 | uAAuAGAuAcAGGUGAUGCdTsdT | 231 |
| AD-40749 | 1329 | AucAGAAcuGGGAuGuuAAdTsdT | 232 | UuAAcAUCCcAGUUCUGAUdTsdT | 233 |
| AD-40755 | 1335 | AcuGGGAuGuuAAGGuGcAdTsdT | 234 | UGcACCUuAAcAUCCcAGUdTsdT | 235 |
| AD-40761 | 1399 | cAAcAucGAGccAcucuuudTsdT | 236 | AAAGAGUGGCUCGAUGUUGdTsdT | 237 |
| AD-40767 | 1534 | cAGAGAcAAGuAucAGcuAdTsdT | 238 | uAGCUGAuACUUGUCUCUGdTsdT | 239 |
| AD-40773 | 1537 | AGAcAAGuAucAGcuAGcAdTsdT | 240 | UGCuAGCUGAuACUUGUCUdTsdT | 241 |
| AD-40779 | 1555 | AucGGGAcAGAAAGGuGuudTsdT | 242 | AAcACCUUUCUGUCCCGAUdTsdT | 234 |
| AD-40785 | 1567 | AGGuGuucAAGuAccAGuAdTsdT | 244 | uACUGGuACUUGAAcACCUdTsdT | 245 |
| AD-40744 | 1708 | GuGGuGuGGAGGGcAcuAAdTsdT | 246 | UuAGUGCCCUCcAcACcACdTsdT | 247 |
| AD-40750 | 1710 | GGuGuGGAGGGcAcuAAGudTsdT | 248 | ACUuAGUGCCCUCcAcACCdTsdT | 249 |
| AD-40756 | 1711 | GuGuGGAGGGcAcuAAGuAdTsdT | 250 | uACUuAGUGCCCUCcAcACdTsdT | 251 |
| AD-40762 | 1830 | uGGcuGuGucuGGuccGuudTsdT | 252 | AACGGACcAGAcAcAGCcAdTsdT | 253 |
| AD-40768 | 1872 | GGAuuuGGGGuuGAGGuGAdTsdT | 254 | UcACCUcAACCCcAAAUCCdTsdT | 255 |
| AD-40774 | 1876 | uuGGGGuuGAGGuGAGucAdTsdT | 256 | UGACUcACCUcAACCCcAAdTsdT | 257 |
| AD-40780 | 1917 | GuuGGGGuGuGGGuGucAudTsdT | 258 | AUGAcACCcAcACCCcAACdTsdT | 259 |
| AD-40786 | 2038 | AGGGuGccAuGAcGAGcAudTsdT | 260 | AUGCUCGUcAUGGcACCCUdTsdT | 261 |

TABLE 2E

Mouse EGNL3 Single Strands and Duplex Sequences

| Duplex Number | Start* | Sequence (5' to 3') Sense | SEQ ID NO. | Sequence (5' to 3') Antisense | SEQ ID NO. |
|---|---|---|---|---|---|
| AD-40745 | 634 | CCGGCUGGGCAAAUACUAU | 262 | AUAGUAUUUGCCCAGCCGG | 263 |
| AD-40751 | 775 | GAAUUGGGACGCCAAGUUA | 264 | UAACUUGGCGUCCCAAUUC | 265 |
| AD-40757 | 819 | CGGAAGGGAAAUCGUUUGU | 266 | ACAAACGAUUUCCCUUCCG | 267 |
| AD-40763 | 882 | CAGACCGCAGGAAUCCACA | 268 | UGUGGAUUCCUGCGGUCUG | 269 |
| AD-40769 | 922 | CACCAGGUACGCUAUGACU | 270 | AGUCAUAGCGUACCUGGUG | 271 |
| AD-40775 | 924 | CCAGGUACGCUAUGACUGU | 272 | ACAGUCAUAGCGUACCUGG | 273 |
| AD-40781 | 937 | GACUGUCUGGUACUUCGAU | 274 | AUCGAAGUACCAGACAGUC | 275 |
| AD-40787 | 1053 | GGCCGCAUUCGUGUAGUAA | 276 | UUACUACACGAAUGCGGCC | 277 |
| AD-40746 | 1055 | CCGCAUUCGUGUAGUAACA | 278 | UGUUACUACACGAAUGCGG | 279 |
| AD-40752 | 1058 | CAUUCGUGUAGUAACAGUU | 280 | AACUGUUACUACACGAAUG | 281 |
| AD-40758 | 1065 | GUAGUAACAGUUCCGGAAA | 282 | UUUCCGGAACUGUUACUAC | 283 |
| AD-40764 | 1068 | GUAACAGUUCCGGAAAUGU | 284 | ACAUUUCCGGAACUGUUAC | 285 |
| AD-40770 | 1265 | CCAGCGGUUUAAAGAUAGA | 286 | UCUAUCUUUAAACCGCUGG | 287 |
| AD-40776 | 1309 | GGACUGCUUCUUAUUCGCA | 288 | UGCGAAUAAGAAGCAGUCC | 289 |
| AD-40782 | 1312 | CUGCUUCUUAUUCGCACUU | 290 | AAGUGCGAAUAAGAAGCAG | 291 |
| AD-40788 | 1318 | CUUAUUCGCACUUUAUGUA | 292 | UACAUAAAGUGCGAAUAAG | 293 |
| AD-40747 | 1334 | GUAUGCGUCCUGAUUUGAA | 294 | UUCAAAUCAGGACGCAUAC | 295 |
| AD-40753 | 1358 | GAGGUUCGCAAAGAAAUAA | 296 | UUAUUUCUUUGCGAACCUC | 297 |
| AD-40759 | 1474 | GACAGUGACGACGACCUAA | 298 | UUAGGUCGUCGUCACUGUC | 299 |
| AD-40765 | 1480 | GACGACGACCUAAUGACAU | 300 | AUGUCAUUAGGUCGUCGUC | 301 |
| AD-40771 | 1482 | CGACGACCUAAUGACAUUA | 302 | UAAUGUCAUUAGGUCGUCG | 303 |
| AD-40777 | 1516 | GCUGCUGCUUAGCAAUCGA | 304 | UCGAUUGCUAAGCAGCAGC | 305 |
| AD-40783 | 1517 | CUGCUGCUUAGCAAUCGAU | 306 | AUCGAUUGCUAAGCAGCAG | 307 |
| AD-40789 | 1548 | CACGGUGGAUGCUCCAUUU | 308 | AAAUGGAGCAUCCACCGUG | 309 |
| AD-40748 | 1571 | GGUUUACGACCCGUACUUU | 310 | AAAGUACGGGUCGUAAACC | 311 |

TABLE 2E-continued

Mouse EGNL3 Single Strands and Duplex Sequences

| Duplex Number | Start* | Sequence (5' to 3') Sense | SEQ ID NO. | Sequence (5' to 3') Antisense | SEQ ID NO. |
|---|---|---|---|---|---|
| AD-40754 | 1815 | CCCAACUUACAUGAUUCGU | 312 | ACGAAUCAUGUAAGUUGGG | 313 |
| AD-40760 | 1929 | GUUCAUCGUCCAUAACAAA | 314 | UUUGUUAUGGACGAUGAAC | 315 |
| AD-40766 | 2034 | CUCACUUGAGUCGUCUUGA | 316 | UCAAGACGACUCAAGUGAG | 317 |
| AD-40772 | 2146 | CCUCCCGAACUCUGUACGA | 318 | UCGUACAGAGUUCGGGAGG | 319 |
| AD-40778 | 2157 | CUGUACGAAACACCUAUUU | 320 | AAAUAGGUGUUUCGUACAG | 321 |
| AD-40784 | 2162 | CGAAACACCUAUUUUACGA | 322 | UCGUAAAAUAGGUGUUUCG | 323 |
| AD-40790 | 2163 | GAAACACCUAUUUUACGAA | 324 | UUCGUAAAAUAGGUGUUUC | 325 |

*Start is the 5' most position on transcript NM_028133.2

TABLE 2F

Mouse EGNL3 Chemically modified Single Strands and Duplex Sequences
For all the sequences in the list, 'endolight' chemistry was applied as described above.

| Duplex Number | Start* | Sequence (5' to 3') Sense | SEQ ID NO. | Sequence (5' to 3') Antisense | SEQ ID NO. |
|---|---|---|---|---|---|
| AD-40745 | 634 | ccGGcuGGGcAAAuAcuAudTsdT | 326 | AuAGuAUUUGCCcAGCcGGdTsdT | 327 |
| AD-40751 | 775 | GAAuuGGGAcGccAAGuuAdTsdT | 328 | uAACUUGGCGUCCcAAUUCdTsdT | 329 |
| AD-40757 | 819 | cGGAAGGGAAAucGuuuGudTsdT | 330 | AcAAACGAUUUCCCUUCCGdTsdT | 331 |
| AD-40763 | 882 | cAGAccGcAGGAAuccAcAdTsdT | 332 | UGUGGAUUCCUGCGGUCUGdTsdT | 333 |
| AD-40769 | 922 | cAccAGGuAcGcuAuGAcudTsdT | 334 | AGUcAuAGCGuACCUGGUGdTsdT | 335 |
| AD-40775 | 924 | ccAGGuAcGcuAuGAcuGudTsdT | 336 | AcAGUcAuAGCGuACCUGGdTsdT | 337 |
| AD-40781 | 937 | GAcuGucuGGuAcuucGAudTsdT | 338 | AUCGAAGuACcAGAcAGUCdTsdT | 339 |
| AD-40787 | 1053 | GGccGcAuucGuGuAGuAAdTsdT | 340 | UuACuAcACGAAUGCGGCCdTsdT | 341 |
| AD-40746 | 1055 | ccGcAuucGuGuAGuAAcAdTsdT | 342 | UGUuACuAcACGAAUGCGGdTsdT | 343 |
| AD-40752 | 1058 | cAuucGuGuAGuAAcAGuudTsdT | 344 | AACUGUuACuAcACGAAUGdTsdT | 345 |
| AD-40758 | 1065 | GuAGuAAcAGuuccGGAAAdTsdT | 346 | UUUCCGGAACUGUuACuACdTsdT | 347 |
| AD-40764 | 1068 | GuAAcAGuuccGGAAAGudTsdT | 348 | AcAUUUCCGGAACUGUuACdTsdT | 349 |
| AD-40770 | 1265 | ccAGcGGuuuAAAGAuAGAdTsdT | 350 | UCuAUCUUuAAACCGCUGGdTsdT | 351 |
| AD-40776 | 1309 | GGAcuGcuucuuAuucGcAdTsdT | 352 | UGCGAAuAAGAAGcAGUCCdTsdT | 353 |
| AD-40782 | 1312 | cuGcuucuuAuucGcAcuudTsdT | 354 | AAGUGCGAAuAAGAAGcAGdTsdT | 355 |
| AD-40788 | 1318 | cuuAuucGcAcuuuAuGuAdTsdT | 356 | uAcAuAAAGUGCGAAuAAGdTsdT | 357 |
| AD-40747 | 1334 | GuAuGcGuccuGAuuuGAAdTsdT | 358 | UUcAAAUcAGGACGcAuACdTsdT | 359 |
| AD-40753 | 1358 | GAGGuucGcAAAGAAAuAAdTsdT | 360 | UuAUUUCUUUGCGAACCUCdTsdT | 361 |
| AD-40759 | 1474 | GAcAGuGAcGAcGAccuAAdTsdT | 362 | UuAGGUCGUCGUcACUGUCdTsdT | 363 |

TABLE 2F-continued

Mouse EGNL3 Chemically modified Single Strands and Duplex Sequences
For all the sequences in the list, 'endolight' chemistry was applied as described above.

| Duplex Number | Start* | Sequence (5' to 3') Sense | SEQ ID NO. | Sequence (5' to 3') Antisense | SEQ ID NO. |
|---|---|---|---|---|---|
| AD-40765 | 1480 | GAcGAcGAccuAAuGAcAudTsdT | 364 | AUGUcAUuAGGUCGUCGUCdTsdT | 365 |
| AD-40771 | 1482 | cGAcGAccuAAuGAcAuuAdTsdT | 366 | uAAUGUcAUuAGGUCGUCGdTsdT | 367 |
| AD-40777 | 1516 | GcuGcuGcuuAGcAAucGAdTsdT | 368 | UCGAUUGCuAAGcAGcAGcdTsdT | 369 |
| AD-40783 | 1517 | cuGcuGcuuAGcAAucGAudTsdT | 370 | AUCGAUUGCuAAGcAGcAGdTsdT | 371 |
| AD-40789 | 1548 | cAcGGuGGAuGcuccAuuudTsdT | 372 | AAAUGGAGcAUCcACCGUGdTsdT | 373 |
| AD-40748 | 1571 | GGuuuAcGAcccGuAcuuudTsdT | 374 | AAAGuACGGGUCGuAAACCdTsdT | 375 |
| AD-40754 | 1815 | cccAAcuuAcAuGAuucGudTsdT | 376 | ACGAAUcAUGuAAGUUGGGdTsdT | 377 |
| AD-40760 | 1929 | GuucAucGuccAuAAcAAAdTsdT | 378 | UUUGUuAUGGACGAUGAACdTsdT | 379 |
| AD-40766 | 2034 | cucAcuuGAGucGucuuGAdTsdT | 380 | UcAAGACGACUcAAGUGAGdTsdT | 381 |
| AD-40772 | 2146 | ccucccGAAcucuGuAcGAdTsdT | 382 | UCGuAcAGAGUUCGGGAGGdTsdT | 383 |
| AD-40778 | 2157 | cuGuAcGAAAcAccuAuuudTsdT | 384 | AAAuAGGGUGUUUCGuAcAGdTsdT | 385 |
| AD-40784 | 2162 | cGAAAcAccuAuuuuAcGAdTsdT | 386 | UCGuAAAAuAGGUGUUUCGdTsdT | 387 |
| AD-40790 | 2163 | GAAAcAccuAuuuuAcGAAdTsdT | 388 | UUCGuAAAAuAGGUGUUUCdTsdT | 389 |

RNA Isolation, cDNA Synthesis and RT-PCR Methods
Total RNA Isolation Using MagMAX-96 Total RNA Isolation Kit (Applied Biosystem, Forer City Calif., Part #: AM1830):

Cells were harvested and lysed in 140 µl of Lysis/Binding Solution then mixed for 1 minute at 850 rpm using and Eppendorf Thermomixer (the mixing speed was the same throughout the process). Twenty micro liters of magnetic beads and Lysis/Binding Enhancer mixture were added into cell-lysate and mixed for 5 minutes. Magnetic beads were captured using magnetic stand and the supernatant was removed without disturbing the beads. After removing supernatant, magnetic beads were washed with Wash Solution 1 (isopropanol added) and mixed for 1 minute. Beads were capture again and supernatant removed. Beads were then washed with 150 µl Wash Solution 2 (Ethanol added), captured and supernatant was removed. 50 ul of DNase mixture (MagMax turbo DNase Buffer and Turbo DNase) was then added to the beads and they were mixed for 10 to 15 minutes. After mixing, 100 µl of RNA Rebinding Solution was added and mixed for 3 minutes. Supernatant was removed and magnetic beads were washed again with 150 µl Wash Solution 2 and mixed for 1 minute and supernatant was removed completely. The magnetic beads were mixed for 2 minutes to dry before RNA was eluted with 50 µl of water.

cDNA Synthesis Using ABI High Capacity cDNA Reverse Transcription Kit (Applied Biosystems, Foster City, Calif., Cat #4368813):

A master mix of 2 µl 10× Buffer, 0.8 µl 25×dNTPs, 2 µl Random primers, 1 µl Reverse Transcriptase, 1 µl RNase inhibitor and 3.2 µl of H2O per reaction were added into 10 µl total RNA. cDNA was generated using a Bio-Rad C-1000 or S-1000 thermal cycler (Hercules, Calif.) through the following steps: 25° C. 10 min, 37° C. 120 min, 85° C. 5 sec, 4° C. hold.

Real Time PCR:

2 µl of cDNA were added to a master mix containing 0.5 µl GAPDH TaqMan Probe (Applied Biosystems Cat #4326317E), 0.5 µl CD274 (PD-L1) TaqMan probe (Applied Biosystems cat # Hs01125301_m1) and 5 µl Roche Probes Master Mix (Roche Cat #04887301001) in a total of 10 µl per well in a LightCycler 480 384 well plate (Roche cat #0472974001). Real time PCR was done in a LightCycler 480 Real Time PCR machine (Roche). Each duplex was tested in at least two independent transfections. Each transfection was assayed by qPCR in duplicate.

Real time data were analyzed using the ΔΔCt method. Each sample was normalized to GAPDH expression and knockdown was assessed relative to cells transfected with the non-targeting duplex AD-1955. IC50s were defined using a 4 parameter fit model in XLfit.

In Vitro Screening of EGLN1, EGLN2, EGLN3 siRNAs for mRNA Suppression

Mouse EGLN1 or EGLN2 or EGLN3 targeting dsRNAs (Tables 2A-F) were assayed for inhibition of endogenous EGLN1, 2, 3 expression in BNLC12 cells, using bDNA (branched DNA) assays to quantify EGLN1,2,3 mRNA. Results from single dose assays were used to select a subset of EGLN1, EGLN2 or EGLN3 dsRNA duplexes for 3 point dose response experiments to determine relative potency. The most potent siRNA for each target-EGLN1,2,3 was selected for further testing in vivo.

Cell Culture and Transfections:

The mouse liver cell line Bnlc12 (ATCC, Manassas, Va.) were grown to near confluence at 37° C. in an atmosphere of 5% CO2 in Dulbecco's modified Eagle's medium (ATCC) supplemented with 10% FBS, streptomycin, and glutamine (ATCC) before being released from the plate by trypsinization. Reverse transfection was carried out by adding 5 µl of Opti-MEM to 5 µl of siRNA duplexes per well into a 96-well plate along with 10 µl of Opti-MEM plus 0.2 µl of Lipofectamine RNAiMax per well (Invitrogen, Carlsbad Calif. cat #13778-150) and incubated at room temperature for 15 minutes. 80 µl of complete growth media without antibiotics containing 2×104 Bnlc12 cells were then added. Cells were incubated for 24 hours prior to preparation of cell lysates for branched DNA. Single dose experiments were performed at 1 nM final duplex concentration and dose response experiments were done with 1, 0.1, and 0.01 nM. Branched DNA (bDNA) Assays—QuantiGene 2.0 (Panomics Cat #: QS0011): Used to Screen Duplexes After a 24 hour incubation at the dose or doses stated, media was removed and cells were lysed in 100 ul Lysis buffer (Epicenter technologies and 10 µl of Proteinase-K/ml for a final concentration of 20 mg/ml) then incubated at 65° C. for 1 hour. 60 µl Working Probe Set (EGLN1, EGLN2 or EGLN3 probe for gene target and GAPDH for endogenous control) and 40 µl of cell-lysate were then added to the Capture Plates. Capture Plates were incubated at 55° C.±1° C. (approx. 16-20 hrs). The next day, the Capture Plates were washed 3 times with 1× Wash Buffer (nuclease-free water, Buffer Component 1 and Wash Buffer Component 2), then dried by centrifuging for 1 minute at 240 g. 100 µl of pre-Amplifier Working Reagent was added to the Capture Plates, which were sealed with aluminum foil and incubated for 1 hour at 55° C.±1° C. Following a 1 hour incubation, the wash step was repeated, then 100 µl Amplifier Working Reagent was added. After 1 hour, the wash and dry steps were repeated, and 100 µl Label Probe was added. Capture plates were incubated 50° C.±1° C. for 1 hour. The plates were then washed with 1× Wash Buffer and dried, and then 100 µl Substrate was added to the Capture Plates. Capture Plates were read using the SpectraMax Luminometer (Molecular Devices, Sunnyvale, Calif.) following 5 to 15 minutes incubation. bDNA data were analyzed by (i) subtracting the average background (no lysate control) from each triplicate sample, (ii) averaging the resultant triplicate GAPDH (control probe) and EGLN1 or EGLN2 or EGLN3 (experimental probe) values, and then (iii) taking the ratio: (experimental probe-background)/(control probe-background).

Results

Figure 1:
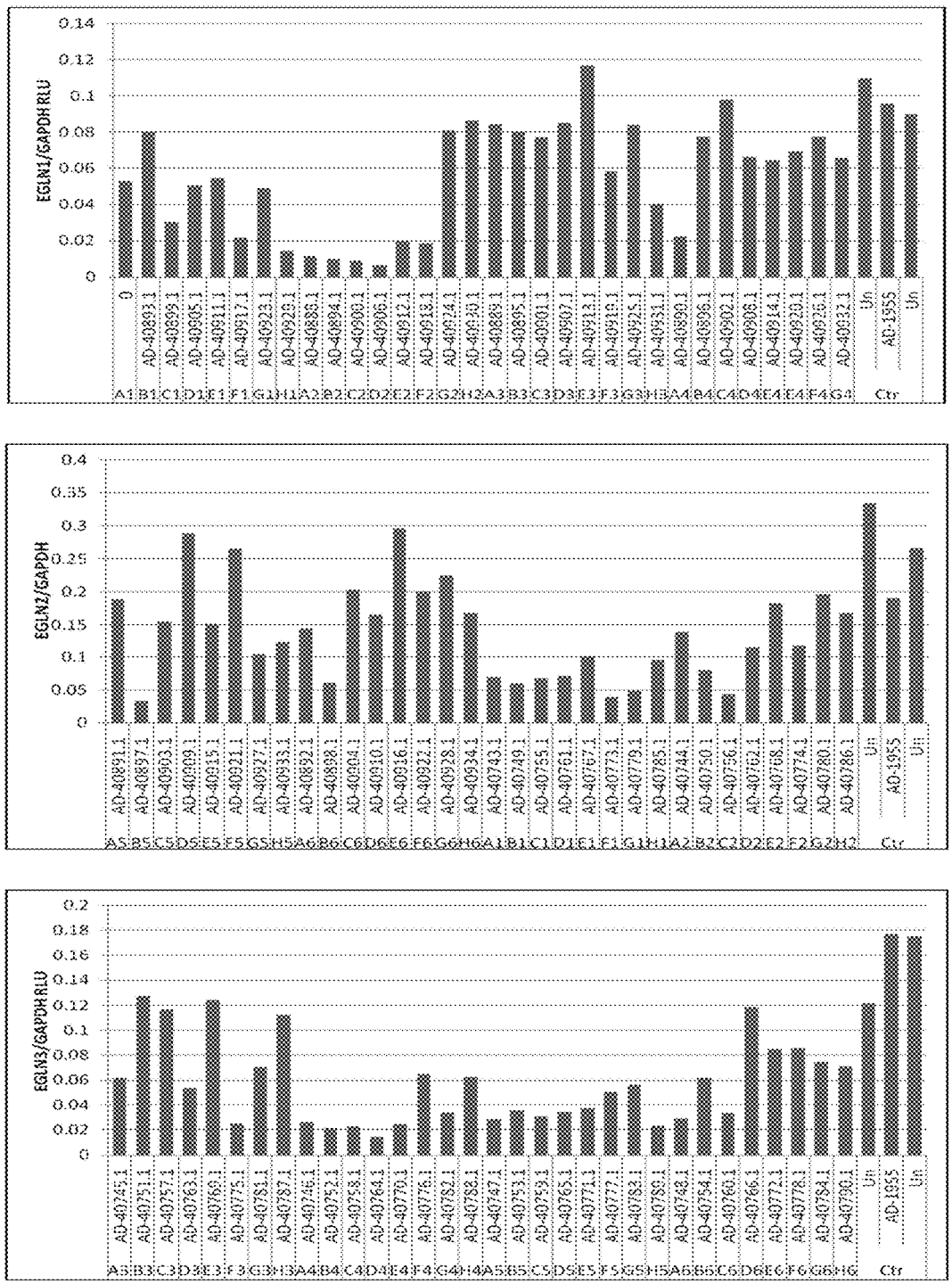
FIG. 1 is a histogram showing the in vitro screening results of the EGLN 1, 2, and 3 genes. AD (duplex) numbers are those listed in Tables 2A-F. The additional digit listed in the figure after the decimal (".") point is an internal tracking number and may be disregarded when making reference to the duplexes listed in the tables.
Figure 2:
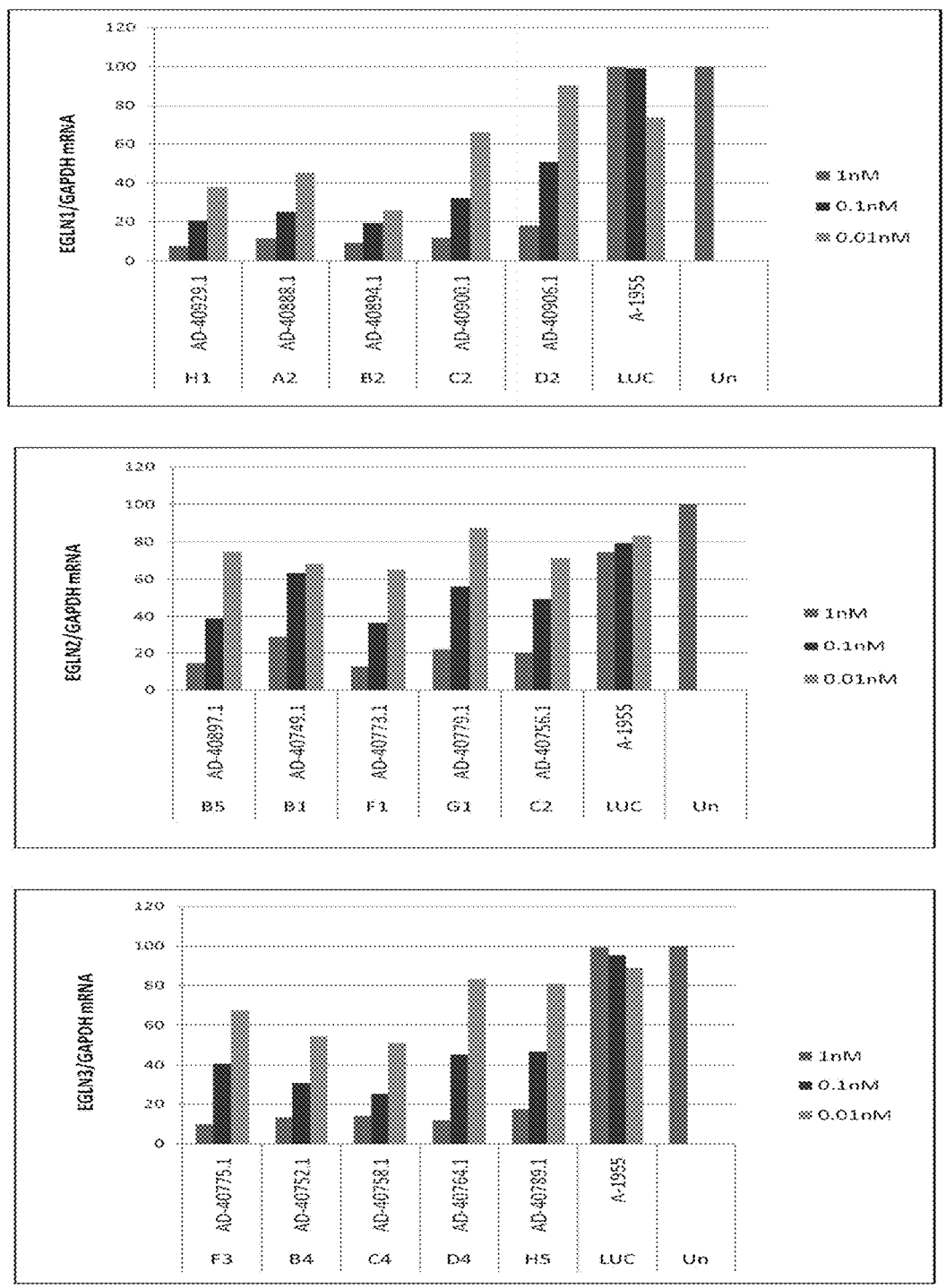
FIG. 2 is a histogram showing the in vitro dose response screening results of the EGLN 1, 2, and 3 genes. AD (duplex) numbers are those listed in Tables 2A-F. The additional digit listed in the figure after the decimal (".") point is an internal tracking number and may be disregarded when making reference to the duplexes listed in the tables.

A summary of the single dose and 3 point dose response curve results for EGLN1, EGLN2, ELGN3-dsRNAs (siRNAs) are presented below in FIGS. 1 and 2. Single dose results are expressed as a ratio of EGLN1, or EGLN2, or EGLN3 to GAPDH mRNA in relative light units. The 3 point dose response data is expressed as % EGLN1, EGLN2 or EGLN3 mRNA relative to control untreated, assayed in BnlC12 cells.

Example 3. In Vivo Knock Down of EGLN Genes

In order to determine whether the iRNA agents to the EGLN genes were specific, knockdown studies were performed using the iRNA agents set out in Table 3.

One siRNA targeting each gene EGLN1 (AD-40894), EGLN2 (AD-40773) and EGLN3 (AD-40758) as well as a mix of all three siRNAs (AD-40894/AD-40773/AD-40758) were formulated in LNP11 (MC3) formulations to test the ability to knockdown their respective mRNAs in the liver. The experimental outline is below in Table 3 and includes control PBS group as well as a control group with an LNP11 formulation containing the Luciferase siRNA AD-1955. The individual formulations were dosed intravenously at 0.3 mg/kg into female C57B6 mice whereas the combination mix formulation was dosed at 1 mg/kg.

At 72 hours after dosing the animals were sacrificed. Plasma samples were taken and livers were removed, flash frozen then ground into powder. Small amounts (~20 mg) of liver powder was disrupted in lysis buffer for mRNA analysis by branched DNA-QuantiGene 2.0 (Panomics cat #: QS0011). The same bDNA assay and probes used for the screening work was used. The data is expressed as percent of PBS control ratios of target (EGLN1, 2, 3) mRNA relative to GAPDH mRNA. The results are shown in FIG. 3.

Figure 3:
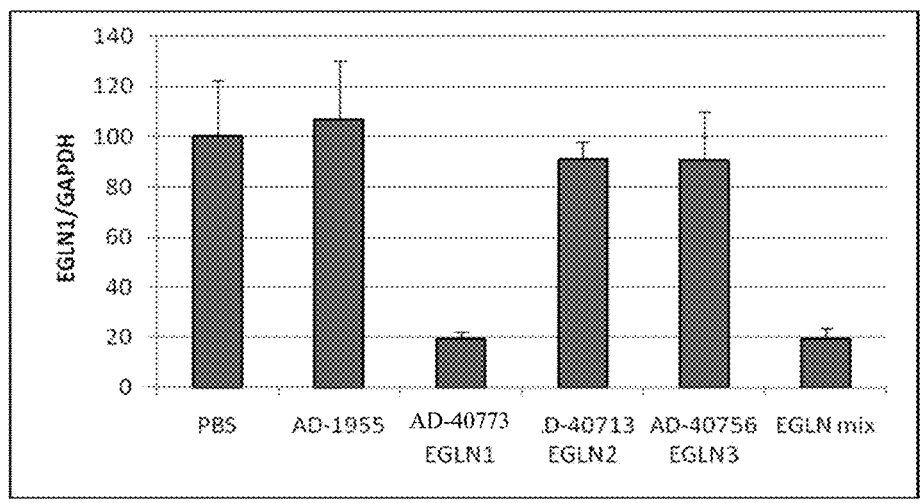
FIG. 3 is a histogram showing the specificity of knockdown of EGLN genes by the iRNA agents of the invention. Panel 1 shows the specificity of the EGLN1 iRNA agent, AD-40894 for EGLN1 and the effect of the 3-iRNA mix. Panel 2 shows the specificity of the EGLN2 iRNA agent, AD-40773 for EGLN2 and the effect of the 3-iRNA mix. Panel 3 shows the specificity of the EGLN3 iRNA agent, AD-40758 for EGLN3 and the effect of the 3-iRNA mix.
Figure 3:
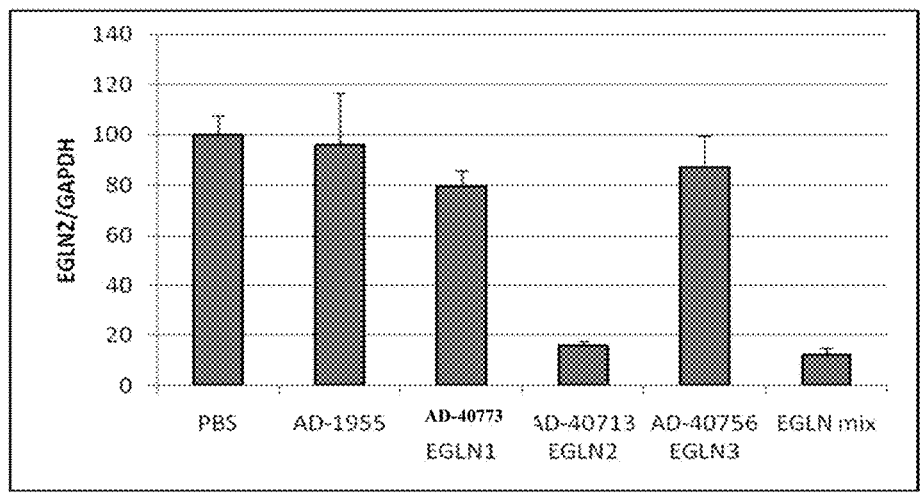
Figure 3:
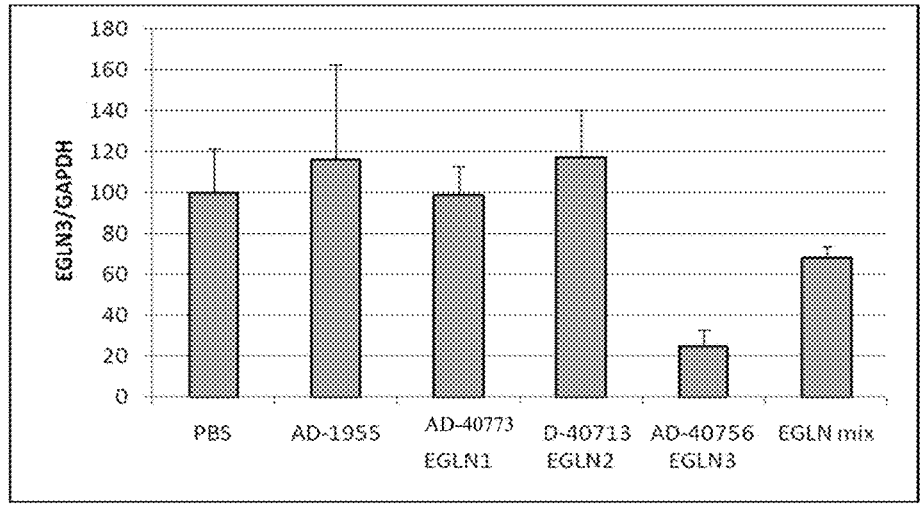

It can be seen from FIG. 3 that the iRNA agents for each EGLN gene are specific to that variant. It is also evident that the mix or cocktail containing all three iRNA was effective in reducing the mRNA level of each EGLN gene.

TABLE 3

In vivo knockdown of EGLN genes

| Group | siRNA | Formulation | Sample Size (n) | Dose (mg/kg) | In vitro IC50 |
|---|---|---|---|---|---|
| PBS | — | | 4 | | |
| Luciferase (control) | AD-1955 | LNP11 | 5 | 0.3 | |
| EGLN1 | AD-40894 | LNP11 | 5 | 0.3 | <10 pM |
| EGLN2 | AD-40773 | LNP11 | 5 | 0.3 | ~50 pM |
| EGLN3 | AD-40758 | LNP11 | 5 | 0.3 | ~10 pM |
| EGLN1,2,3 mix | AD-40894 (25%) AD-40773 (50%) AD-40758 (25%) | LNP11 | 5 | 1 | |

Example 4. In Vivo Induction of Hepatic Erythropoietin (EPO)

Figure 4A:
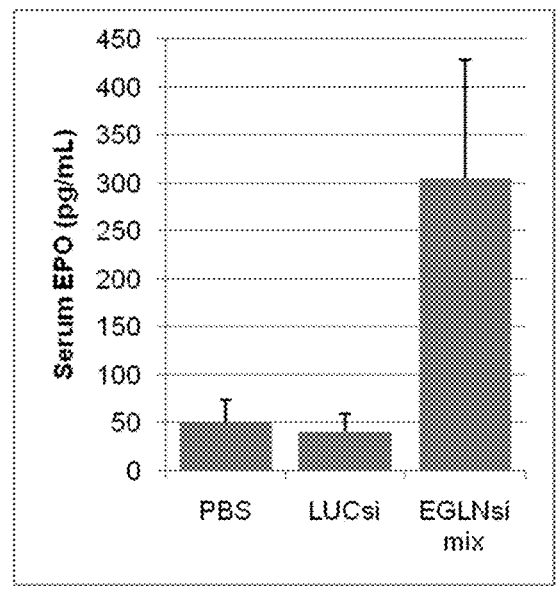
FIGS. 4A and 4B show results from an ELISA assay.
Figure 4B:
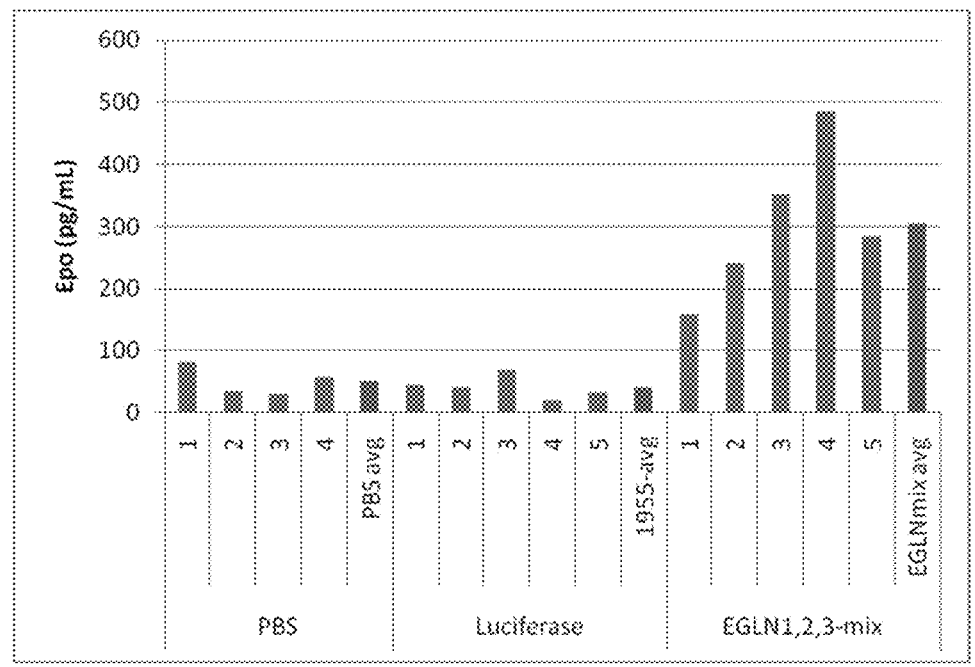

In order to determine if knockdown of the three EGLN (HIF prolyl hydroxylases) genes simultaneously in the liver will induce downstream hepatic Epo (Erythropoetin) production, mice were injected IV with iRNA agents directed to each EGLN gene at 0.3 mg/kg or with a mix of all three EGLN iRNA agents (1 mg/kg) as described in Table 3 above. All iRNA agents were delivered in formulation LNP11. At 72 hours, the animals were sacrificed and livers taken for bDNA analysis. Serum was also taken for erythropoietin (EPO) measurements by ELISA kit (R&D Systems) according to the manufacturer's instructions. The results are shown in FIGS. 4A and 4B.

Only the serum samples for the PBS, Luciferase (AD-1955) and LNP11-AD-40894/AD-40773/AD-40758 (EGLN1,2,3 mix) formulation were measured for EPO. The data indicate that only serum from animals treated with the LNP11-AD-40894/AD-40773/AD-40758 treated animals showed an increase in EPO levels which was not seen in serum from animals treated with PBS or control Luciferase. Therefore, siRNA formulations that knockdown of all three EGLNs 1, 2, 3 simultaneously in liver can induce an increase in hepatic EPO production measured in serum.

Example 5. In Vivo Dose Response of EGLN in Liver

Figure 5:
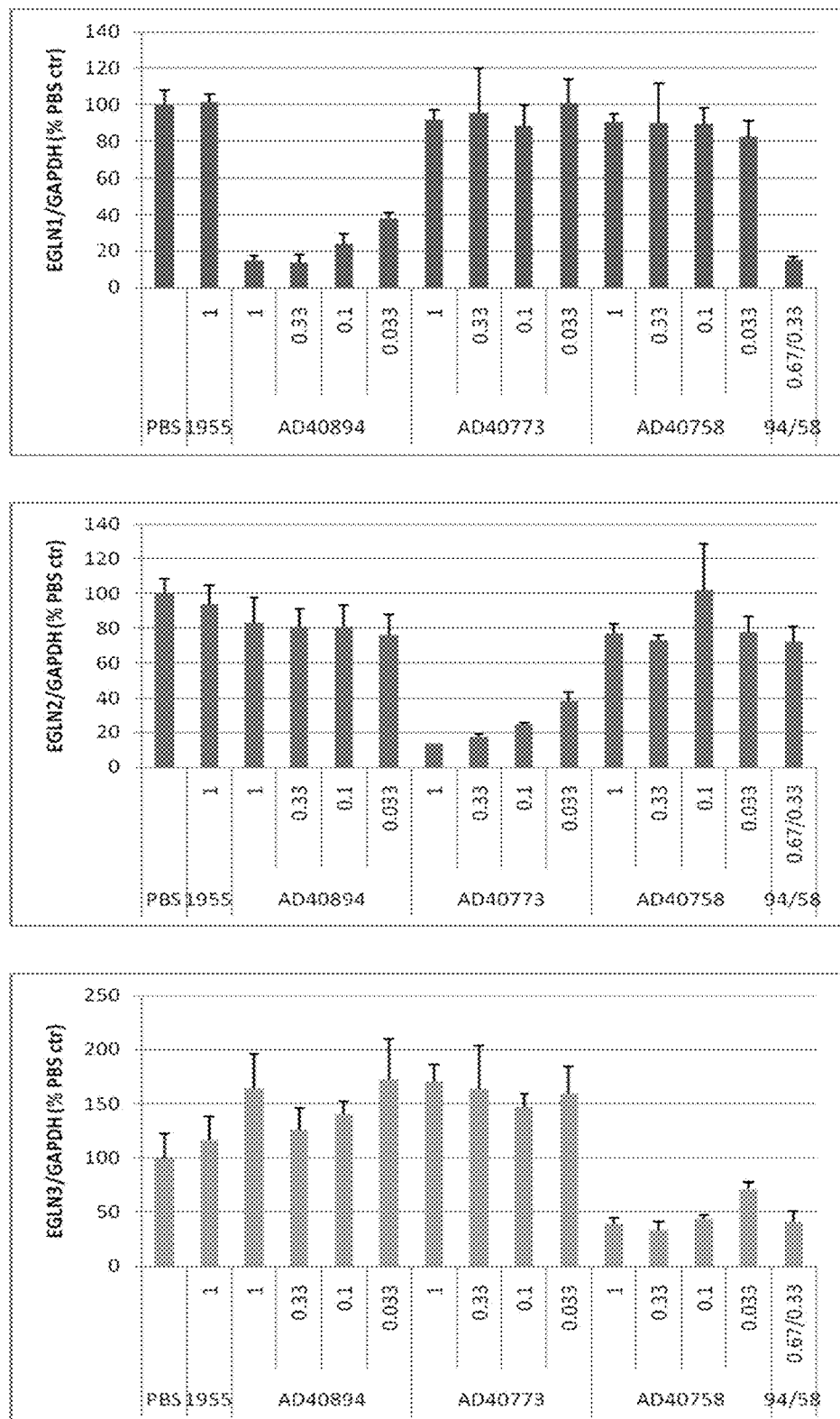
FIG. 5 is a histogram showing the specificity of knockdown of EGLN genes by the iRNA agents of the invention in a dose response study (mg per kg). Panel 1 shows the specificity of the EGLN1 iRNA agent, AD-40894 for EGLN1. Panel 2 shows the specificity of the EGLN2 iRNA agent, AD-40773 for EGLN2. Panel 3 shows the specificity of the EGLN3 iRNA agent, AD-40758 for EGLN3. Each panel also shows the knockdown of the respective EGLN gene using a dual iRNA agent mix (AD-04894 and AD-40758, "94/58" in amounts of 67% and 33% "0.67/0.33")

In order to evaluate the efficacy of the iRNA agents directed to EGLN genes, dose response studies were conducted for the individual EGLNs in liver. For these studies, mice (3 animals per group) were injected IV with formulations at doses outlined in Table 4. A mix of EGLN1 and EGLN3 formulations were tested to confirm if co-injection of individual LNP11 formulations with siRNA against single targets worked as well as injection of a single formulation with siRNAs against all 3 EGLN targets. At 72 hours, the animals were sacrificed and livers taken for bDNA and serum taken for Epo measurements by ELISA. The results are shown in FIG. 5.

Results

It was found that all three formulations LNP11-40894, LNP11-40773, and LNP11-40758 dose dependently knocked down the respective mRNA levels of EGLN1, EGLN2 and EGLN3 after IV administration into C57B6 mice. The relative IC50 values in vivo were less than 0.033 for LNP11-40894 targeting EGLN1, less than 0.033 for LNP11-40773 targeting of EGLN2 and approximately 0.05 for LNP11-40758. Furthermore, it was possible to detect knockdown of EGLN1 and EGLN3 mRNAs by injection of LNP11-40894 and LNP11-40758, suggesting that the siRNAs don't have to be inside the same liposome together to silence both targets simultaneously.

TABLE 4

In vivo knockdown of EGLN genes

| Group | siRNA | Formulation | Sample Size (n) | Dose (mg/kg) | In vitro IC50 |
|---|---|---|---|---|---|
| PBS | — | | 3 | | |
| Luciferase | AD-1955 | LNP11 | 3 | 1 | |
| EGLN1 | AD-40894 | LNP11 | 3 (12 total) | 1 | <10 pM |
| | | | | 0.33 | |
| | | | | 0.1 | |
| | | | | 0.033 | |
| EGLN2 | AD-40773 | LNP11 | 3 (12 total) | 1 | ~50 pM |
| | | | | 0.33 | |
| | | | | 0.1 | |
| | | | | 0.033 | |
| EGLN3 | AD-40758 | LNP11 | 3 (12 total) | 1 | ~10 pM |
| | | | | 0.33 | |
| | | | | 0.1 | |
| | | | | 0.033 | |
| EGLN1,3 mix | AD-40894 (67%) AD-40758 (33%) | LNP11 | 3 | 0.67/0.33 | |

Example 6. In Vivo Production of Erythropoietin and Hematology

Figure 6:
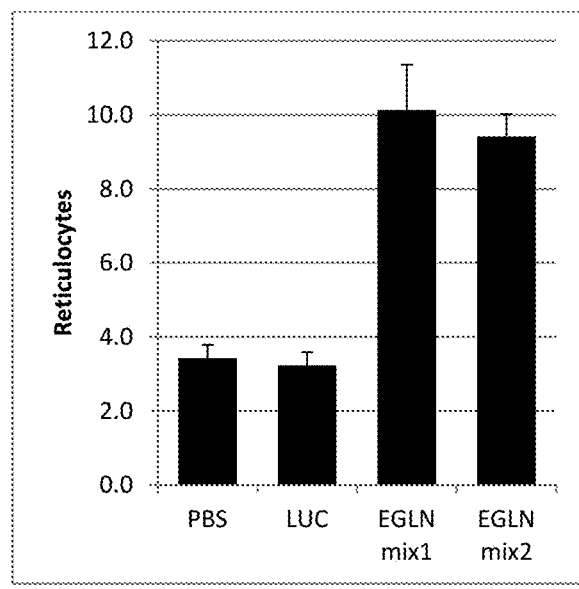
FIG. 6 is a histogram of the Week 1 hematology results showing reticulocyte and RBC levels upon treatment with a composition comprising an EGLN1-3 mix of iRNA agents.
Figure 6:
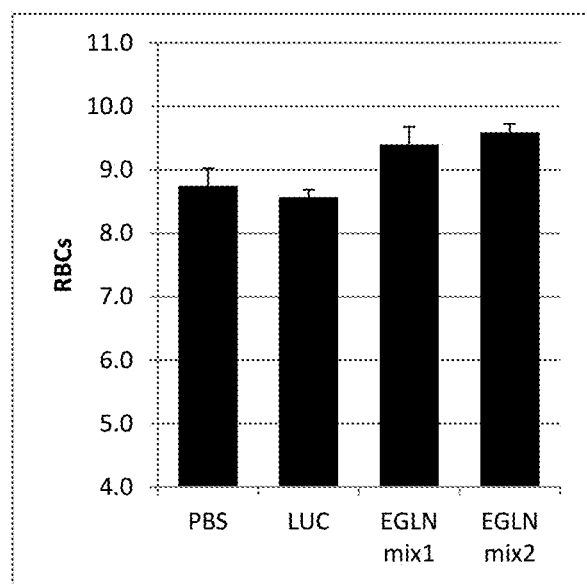
Figure 7:
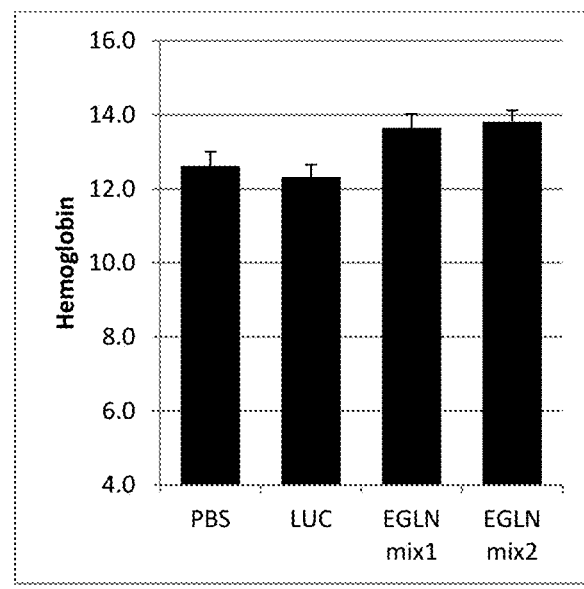
FIG. 7 is a histogram of the Week 1 hematology results showing hemoglobin and hematocrit levels upon treatment with a composition comprising an EGLN1-3 mix of iRNA agents.
Figure 7:
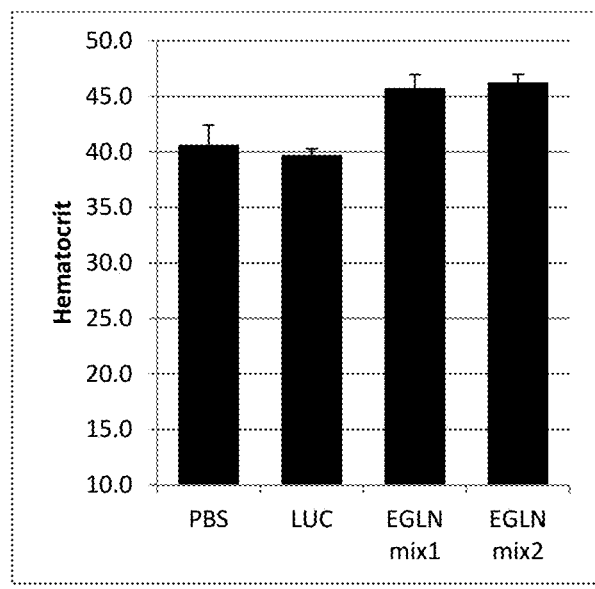
Figure 8:
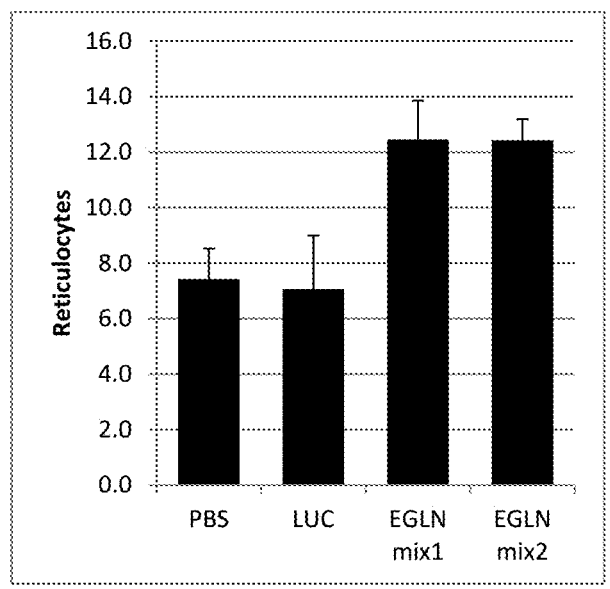
FIG. 8 is a histogram of the Week 2 hematology results showing reticulocyte and RBC levels upon treatment with a composition comprising an EGLN1-3 mix of iRNA agents.
Figure 8:
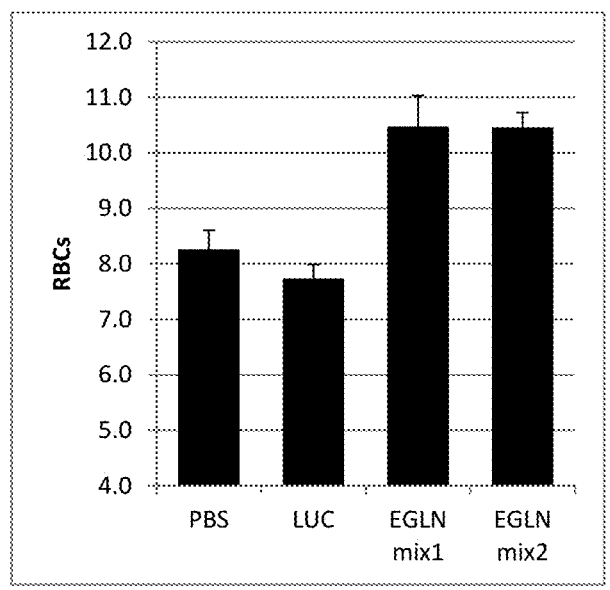
Figure 9:
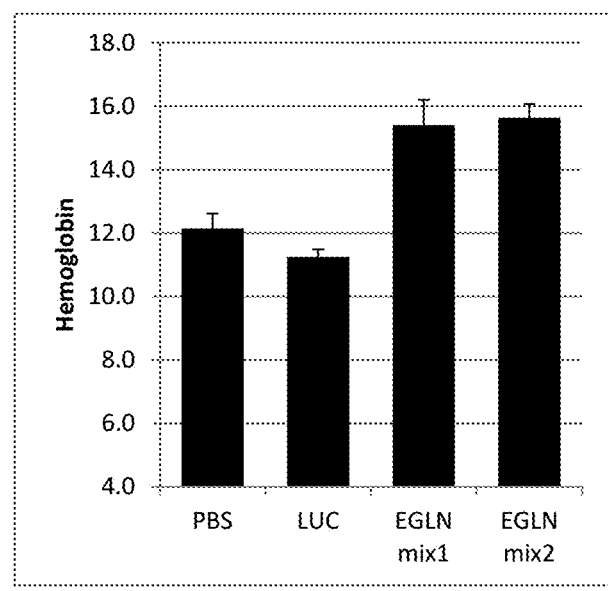
FIG. 9 is a histogram of the Week 2 hematology results showing hemoglobin and hematocrit levels upon treatment with a composition comprising an EGLN1-3 mix of iRNA agents.
Figure 9:
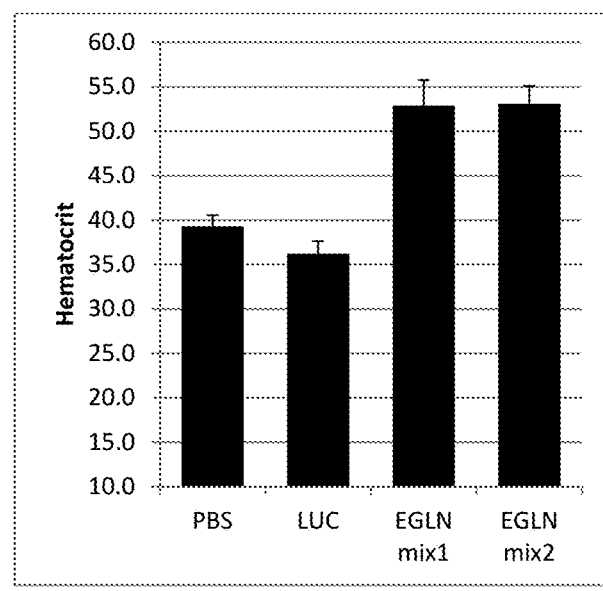

In order to determine whether administration of an EGLN iRNA cocktail was capable of increasing erythropoietin expression in vivo, a study was designed according to Table 5. Female C57B6 mice were dosed IV with PBS or LNP11-1955 luciferase controls or two different mixes of EGLN siRNA formulations at two different doses 1.5 or 1.33 mg/kg respectively. On day 5 after the first dose plasma samples were taken from each animal for hematology measurements. On day 7, a second dose of the same amount of a mix of LNP11 formulations or controls was given. Then on day 10 a second set of plasma samples were taken, animals were sacrificed and livers were harvested for measurement of EGLN1, EGLN2, EGLN3 and EPO mRNA measurements again by branched DNA analysis. At 72 hours, after the 1$^{st}$ dose blood was drawn for hematology measurements including a count of reticulocytes, red blood cells, hemoglobin measurements and hematocrit levels. At 72 hours after the 2$^{nd}$ dose animals were sacrificed and livers taken for bDNA analysis. The Week 1 data are shown in FIGS. 6 and 7 while Week 2 data are shown in FIGS. 8 and 9.

TABLE 5

In vivo knockdown of EGLN genes

| Group | siRNA | Formulation | Sample size (n) | Dose (mg/kg) |
|---|---|---|---|---|
| PBS | — | | 5 | |
| Luciferase | AD-1955 | LNP11 | 5 | 1 |
| EGLN1,2,3 mix 1 | AD-40894 (.375 mpk) AD-40773 (.75 mpk) AD-40758 (.375 mpk) | LNP11 | 15 | 1.5 |
| EGLN1,2,3 mix 2 | AD-40894 (.25 mpk) AD-40773 (.5 mpk) AD-40758 (.58 mpk) | LNP11 | 10 | 1.33 |

It can be seen from FIGS. 6-9 that in both Weeks 1 and 2 that both mix 1 and mix 2 result in observable changes. It was found that by day 5 after the first dose a large increase in reticulocyte levels and a small increase in hematocrit readouts could be detected. By day 10, now after 2 injections of the mix of LNP11 formulations with EGLN1, EGLN2 and EGLN3 siRNAs, a considerable increase in reticulocytes versus control was observed with an even larger increase in hematocrit, RBC count and hemoglobin levels in the plasma. Collectively, knockdown of EGLN1,2,3 led to an increase in liver EPO mRNA and stimulated erythropoiesis.

Figure 10:
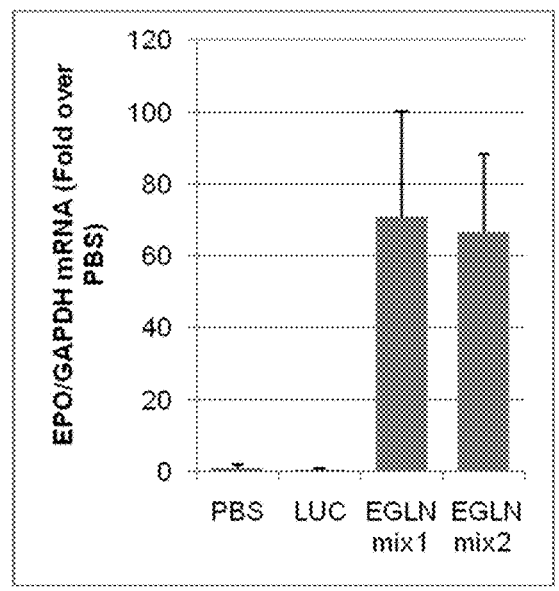
FIG. 10 is a histogram showing the increase of EPO mRNA after 2 doses at day 10.

Furthermore, it was found that injection of the mix of 3 LNPs targeting each EGLN gene resulted in knockdown of all three EGLN targets EGLN1, ELGN2, and EGLN3 while simultaneously leading to an increase of EPO mRNA after 2 doses at day 10. The data are shown in FIG. 10. The luciferase siRNA and PBS treated animals had EPO mRNA levels at essentially background levels in the liver whereas in the EGLN siRNA mix treated group there was strong EPO mRNA expression. EGLN1, EGLN2, EGLN3, and EPO mRNA levels were normalized to housekeeping GAPDH control and data is expressed as a percentage of the PBS control expression.

From these data, it may be concluded that simultaneous knockdown of all three EGLN genes in the liver is possible with each siRNA in their own LNP formulations, then mixing them prior to injection. The knockdown of the 3 EGLN genes lead to a very dramatic increased expression of EPO mRNA as compared to the PBS control or Luciferase siRNA treated groups where liver EPO mRNA was undetectable and at background levels of the assay. Furthermore, it was found that by turning on EPO mRNA expression in the liver by knocking down the 3 EGLN genes a dramatic increase in erythropoiesis occurs. This could be measured in the blood from dosed animals where a dramatic increase in reticulocytes or (immature red blood cells) was observed even after the first dose of EGLN1,2,3 siRNA mix treatment. After the second dose it was evident that a significant increase in not only reticulocytes but also RBC count, hemoglobin and Hematocrit measurements was occurring.

Example 7. Design of siRNA Targeting Human EGLN Genes

Oligonucleotide design was carried out to identify siRNAs targeting the genes encoding the human (*Homo sapiens*) EGLN 1, 2 and 3 genes. The design process used the EGLN transcript NM_022051.2 for EGLN1 (SEQ ID NO: 390), NM_053046.2 for EGLN2 (SEQ ID NO: 391), and NM_022073.3 for EGLN3 (SEQ ID NO: 392). All sequences were obtained from the NCBI Refseq collection. Start refers to the 5' most position on the target.

It should be understood that while the sequences disclosed in Tables 6A-C are represented as 19mer oligonucleotides, the duplexes formed from such oligonucleotides may be 19mer blunt ended constructs or may be modified by the addition of one or more nucleotides on the 3' end of the strands, preferably a dTdT modification to produce 21mer duplexes having 2 nucleotide 3' overhangs.

TABLE 6A

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 40 | AGAGACACAAGGCUUUGUU | 393 | AACAAAGCCUUGUGUCUCU | 394 |
| 55 | UGUUUGCCCCAGAGUAUUA | 395 | UAAUACUCUGGGGCAAACA | 396 |
| 59 | UGCCCCAGAGUAUUAGUUA | 397 | UAACUAAUACUCUGGGGCA | 398 |
| 60 | GCCCCAGAGUAUUAGUUAA | 399 | UUAACUAAUACUCUGGGGC | 400 |
| 64 | CAGAGUAUUAGUUAACCCA | 401 | UGGGUUAACUAAUACUCUG | 402 |
| 70 | AUUAGUUAACCCACCUAGU | 403 | ACUAGGUGGGUUAACUAAU | 404 |
| 73 | AGUUAACCCACCUAGUGCU | 405 | AGCACUAGGUGGGUUAACU | 406 |
| 77 | AACCCACCUAGUGCUCCUA | 407 | UAGGAGCACUAGGUGGGUU | 408 |
| 79 | CCCACCUAGUGCUCCUAAU | 409 | AUUAGGAGCACUAGGUGGG | 410 |
| 86 | AGUGCUCCUAAUCAUACAA | 411 | UUGUAUGAUUAGGAGCACU | 412 |
| 132 | GCCUCACUCUCUAUUUGUU | 413 | AACAAAUAGAGAGUGAGGC | 414 |
| 153 | ACCUUCUGUAAAAUUGGUA | 415 | UACCAAUUUUACAGAAGGU | 416 |
| 168 | GGUAGAAUAAUAGUACCCA | 417 | UGGGUACUAUUAUUCUACC | 418 |
| 170 | UAGAAUAAUAGUACCCACU | 419 | AGUGGGUACUAUUAUUCUA | 420 |
| 171 | AGAAUAAUAGUACCCACUU | 421 | AAGUGGGUACUAUUAUUCU | 422 |
| 179 | AGUACCCACUUCAUAGCAU | 423 | AUGCUAUGAAGUGGGUACU | 424 |
| 201 | AUGAUGAUUAAAUUGGUUA | 425 | UAACCAAUUUAAUCAUCAU | 426 |
| 235 | UUAGAACACAGAUUGGGCA | 427 | UGCCCAAUCUGUGUUCUAA | 428 |
| 245 | GAUUGGGCACAUAACAGCA | 429 | UGCUGUUAUGUGCCCAAUC | 430 |
| 249 | GGGCACAUAACAGCAAGCA | 431 | UGCUUGCUGUUAUGUGCCC | 432 |
| 255 | AUAACAGCAAGCACCACAU | 433 | AUGUGGUGCUUGCUGUUAU | 434 |
| 287 | AAAUUCCUUUGUGUUGCCU | 435 | AGGCAACACAAAGGAAUUU | 436 |
| 292 | CCUUUGUGUUGCCUUCCGU | 437 | ACGGAAGGCAACACAAAGG | 438 |
| 293 | CUUUGUGUUGCCUUCCGUU | 439 | AACGGAAGGCAACACAAAG | 440 |
| 295 | UUGUGUUGCCUUCCGUUAA | 441 | UUAACGGAAGGCAACACAA | 442 |
| 296 | UGUGUUGCCUUCCGUUAAA | 443 | UUUAACGGAAGGCAACACA | 444 |
| 298 | UGUUGCCUUCCGUUAAAGU | 445 | ACUUUAACGGAAGGCAACA | 446 |
| 299 | GUUGCCUUCCGUUAAAGUU | 447 | AACUUUAACGGAAGGCAAC | 448 |
| 336 | AAUAAAUACUUGCAUGACA | 449 | UGUCAUGCAAGUAUUUAUU | 450 |
| 360 | AAGUCUCUCUAUAACAUCU | 451 | AGAUGUUAUAGAGAGACUU | 452 |
| 368 | CUAUAACAUCUGAGUAAGU | 453 | ACUUACUCAGAUGUUAUAG | 454 |
| 375 | AUCUGAGUAAGUGGCGGCU | 455 | AGCCGCCACUUACUCAGAU | 456 |
| 389 | CGGCUGCGACAAUGCUACU | 457 | AGUAGCAUUGUCGCAGCCG | 458 |
| 394 | GCGACAAUGCUACUGGAGU | 459 | ACUCCAGUAGCAUUGUCGC | 460 |

TABLE 6A-continued

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 395 | CGACAAUGCUACUGGAGUU | 461 | AACUCCAGUAGCAUUGUCG | 462 |
| 411 | GUUCCAGAAUCGUGUUGGU | 463 | ACCAACACGAUUCUGGAAC | 464 |
| 428 | GUGACAAGAUUGUUCACCA | 465 | UGGUGAACAAUCUUGUCAC | 466 |
| 434 | AGAUUGUUCACCAGCAUAU | 467 | AUAUGCUGGUGAACAAUCU | 468 |
| 439 | GUUCACCAGCAUAUGGUGU | 469 | ACACCAUAUGCUGGUGAAC | 470 |
| 444 | CCAGCAUAUGGUGUGGUGA | 471 | UCACCACACCAUAUGCUGG | 472 |
| 453 | GGUGUGGUGAAAACUCACU | 473 | AGUGAGUUUUCACCACACC | 474 |
| 455 | UGUGGUGAAAACUCACUAA | 475 | UUAGUGAGUUUUCACCACA | 476 |
| 457 | UGGUGAAAACUCACUAAUU | 477 | AAUUAGUGAGUUUUCACCA | 478 |
| 458 | GGUGAAAACUCACUAAUUU | 479 | AAAUUAGUGAGUUUUCACC | 480 |
| 488 | AGAUUAUUAAGCCUGAAUA | 481 | UAUUCAGGCUUAAUAAUCU | 482 |
| 491 | UUAUUAAGCCUGAAUAGGU | 483 | ACCUAUUCAGGCUUAAUAA | 484 |
| 493 | AUUAAGCCUGAAUAGGUGA | 485 | UCACCUAUUCAGGCUUAAU | 486 |
| 494 | UUAAGCCUGAAUAGGUGAA | 487 | UUCACCUAUUCAGGCUUAA | 488 |
| 495 | UAAGCCUGAAUAGGUGAAA | 489 | UUUCACCUAUUCAGGCUUA | 490 |
| 519 | GAAAUCAAGGAUCUUUGGA | 491 | UCCAAAGAUCCUUGAUUUC | 492 |
| 579 | UUAAAGUGUUGCAAGUGUU | 493 | AACACUUGCAACACUUUAA | 494 |
| 597 | UCUAUUUGAUGGAUUAAGU | 495 | ACUUAAUCCAUCAAAUAGA | 496 |
| 598 | CUAUUUGAUGGAUUAAGUA | 497 | UACUUAAUCCAUCAAAUAG | 498 |
| 599 | UAUUUGAUGGAUUAAGUAU | 499 | AUACUUAAUCCAUCAAAUA | 500 |
| 600 | AUUUGAUGGAUUAAGUAUA | 501 | UAUACUUAAUCCAUCAAAU | 502 |
| 601 | UUUGAUGGAUUAAGUAUAU | 503 | AUAUACUUAAUCCAUCAAA | 504 |
| 610 | UUAAGUAUAUUUAGGAUAU | 505 | AUAUCCUAAAUAUACUUAA | 506 |
| 611 | UAAGUAUAUUUAGGAUAUA | 507 | UAUAUCCUAAAUAUACUUA | 508 |
| 687 | UGAUAUGGACAUCUAUUCU | 509 | AGAAUAGAUGUCCAUAUCA | 510 |
| 688 | GAUAUGGACAUCUAUUCUU | 511 | AAGAAUAGAUGUCCAUAUC | 512 |
| 706 | UUUAAGUAAACUUCAAUGA | 513 | UCAUUGAAGUUUACUUAAA | 514 |
| 721 | AUGAAAUAUAUGAGUAGA | 515 | UCUACUCAUAUAUUUCAU | 516 |
| 724 | AAAUAUAUGAGUAGAGCA | 517 | UGCUCUACUCAUAUAUUUU | 518 |
| 725 | AAAUAUGAGUAGAGCAU | 519 | AUGCUCUACUCAUAUAUUU | 520 |
| 726 | AAUAUAUGAGUAGAGCAUA | 521 | UAUGCUCUACUCAUAUAUU | 522 |
| 727 | AUAUAUGAGUAGAGCAUAU | 523 | AUAUGCUCUACUCAUAUAU | 524 |
| 728 | UAUAUGAGUAGAGCAUAUA | 525 | UAUAUGCUCUACUCAUAUA | 526 |
| 730 | UAUGAGUAGAGCAUAUAGA | 527 | UCUAUAUGCUCUACUCAUA | 528 |
| 771 | ACCACAGACUGAAAUAGCA | 529 | UGCUAUUUCAGUCUGUGGU | 530 |
| 827 | GGAAUGAGUCCUCCUAGUA | 531 | UACUAGGAGGACUCAUUCC | 532 |
| 828 | GAAUGAGUCCUCCUAGUAA | 533 | UUACUAGGAGGACUCAUUC | 534 |

TABLE 6A-continued

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 829 | AAUGAGUCCUCCUAGUAAA | 535 | UUUACUAGGAGGACUCAUU | 536 |
| 832 | GAGUCCUCCUAGUAAAGUU | 537 | AACUUUACUAGGAGGACUC | 538 |
| 849 | UUCCUGCUCUUGUGAAUAA | 539 | UUAUUCACAAGAGCAGGAA | 540 |
| 859 | UGUGAAUAAUUAAGCCUCA | 541 | UGAGGCUUAAUUAUUCACA | 542 |
| 868 | UUAAGCCUCAUGUAUAAUU | 543 | AAUUAUACAUGAGGCUUAA | 544 |
| 872 | GCCUCAUGUAUAAUUACUA | 545 | UAGUAAUUAUACAUGAGGC | 546 |
| 901 | AAGCCUAAGAAGUAUUAGA | 547 | UCUAAUACUUCUUAGGCUU | 548 |
| 903 | GCCUAAGAAGUAUUAGACU | 549 | AGUCUAAUACUUCUUAGGC | 550 |
| 973 | UUAAAUGCUUAUUUUCGUA | 551 | UACGAAAAUAAGCAUUUAA | 552 |
| 978 | UGCUUAUUUUCGUAAGCCA | 553 | UGGCUUACGAAAAUAAGCA | 554 |
| 984 | UUUUCGUAAGCCAUGAGAU | 555 | AUCUCAUGGCUUACGAAAA | 556 |
| 996 | AUGAGAUAGCUCCUUUAUA | 557 | UAUAAAGGAGCUAUCUCAU | 558 |
| 1042 | UGGAUUUAUUAGUGCAAA | 559 | UUUGCACUAAUAAAUCCA | 560 |
| 1062 | GGCAGAGCUAGCAAUUCCU | 561 | AGGAAUUGCUAGCUCUGCC | 562 |
| 1105 | AUUCAUCCCUCUUUUAGGA | 563 | UCCUAAAAGAGGGAUGAAU | 564 |
| 1159 | UGCCUCCUGCAUUGGACUA | 565 | UAGUCCAAUGCAGGAGGCA | 566 |
| 1160 | GCCUCCUGCAUUGGACUAU | 567 | AUAGUCCAAUGCAGGAGGC | 568 |
| 1162 | CUCCUGCAUUGGACUAUGU | 569 | ACAUAGUCCAAUGCAGGAG | 570 |
| 1179 | GUGUCUCUGAGUGUAGUAU | 571 | AUACUACACUCAGAGACAC | 572 |
| 1185 | CUGAGUGUAGUAUGACUAA | 573 | UUAGUCAUACUACACUCAG | 574 |
| 1186 | UGAGUGUAGUAUGACUAAU | 575 | AUUAGUCAUACUACACUCA | 576 |
| 1187 | GAGUGUAGUAUGACUAAUU | 577 | AAUUAGUCAUACUACACUC | 578 |
| 1189 | GUGUAGUAUGACUAAUUCA | 579 | UGAAUUAGUCAUACUACAC | 580 |
| 1211 | GUUUGUCAAGGACUCUCAA | 581 | UUGAGAGUCCUUGACAAAC | 582 |
| 1216 | UCAAGGACUCUCAAUGCAU | 583 | AUGCAUUGAGAGUCCUUGA | 584 |
| 1221 | GACUCUCAAUGCAUUUGUU | 585 | AACAAAUGCAUUGAGAGUC | 586 |
| 1233 | AUUUGUUGAACAGCCUAAU | 587 | AUUAGGCUGUUCAACAAAU | 588 |
| 1237 | GUUGAACAGCCUAAUUAGU | 589 | ACUAAUUAGGCUGUUCAAC | 590 |
| 1238 | UUGAACAGCCUAAUUAGUA | 591 | UACUAAUUAGGCUGUUCAA | 592 |
| 1242 | ACAGCCUAAUUAGUAAUGU | 593 | ACAUUACUAAUUAGGCUGU | 594 |
| 1244 | AGCCUAAUUAGUAAUGUCU | 595 | AGACAUUACUAAUUAGGCU | 596 |
| 1254 | GUAAUGUCUGCAACAAUGA | 597 | UCAUUGUUGCAGACAUUAC | 598 |
| 1285 | UUUAAUAAAGCUCUGGGAA | 599 | UUCCCAGAGCUUUAUUAAA | 600 |
| 1286 | UUAAUAAAGCUCUGGGAAA | 601 | UUUCCCAGAGCUUUAUUAA | 602 |
| 1293 | AGCUCUGGGAAAGUAGGAU | 603 | AUCCUACUUUCCCAGAGCU | 604 |
| 1296 | UCUGGGAAAGUAGGAUACA | 605 | UGUAUCCUACUUUCCCAGA | 606 |
| 1303 | AAGUAGGAUACACAUAAGA | 607 | UCUUAUGUGUAUCCUACUU | 608 |

TABLE 6A-continued

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 1308 | GGAUACACAUAAGACAGGU | 609 | ACCUGUCUUAUGUGUAUCC | 610 |
| 1314 | ACAUAAGACAGGUCUAGGU | 611 | ACCUAGACCUGUCUUAUGU | 612 |
| 1319 | AGACAGGUCUAGGUCUAAA | 613 | UUUAGACCUAGACCUGUCU | 614 |
| 1320 | GACAGGUCUAGGUCUAAAU | 615 | AUUUAGACCUAGACCUGUC | 616 |
| 1323 | AGGUCUAGGUCUAAAUUCU | 617 | AGAAUUUAGACCUAGACCU | 618 |
| 1324 | GGUCUAGGUCUAAAUUCUU | 619 | AAGAAUUUAGACCUAGACC | 620 |
| 1328 | UAGGUCUAAAUUCUUUACA | 621 | UGUAAAGAAUUUAGACCUA | 622 |
| 1338 | UUCUUUACAGAAACUUGGA | 623 | UCCAAGUUUCUGUAAAGAA | 624 |
| 1403 | GUUUCCCAAAGGACAAGCU | 625 | AGCUUGUCCUUUGGGAAAC | 626 |
| 1434 | CAUCCUCUUUCACUUGAUU | 627 | AAUCAAGUGAAAGAGGAUG | 628 |
| 1470 | UUUACGCAUGCAGCAGGAU | 629 | AUCCUGCUGCAUGCGUAAA | 630 |
| 1471 | UUACGCAUGCAGCAGGAUU | 631 | AAUCCUGCUGCAUGCGUAA | 632 |
| 1482 | GCAGGAUUUUAUAACAGUU | 633 | AACUGUUAUAAAAUCCUGC | 634 |
| 1572 | UGGUUUACAAUAAUUCCUU | 635 | AAGGAAUUAUUGUAAACCA | 636 |
| 1606 | AAUACAUAUUACAACUUUU | 637 | AAAAGUUGUAAUAUGUAUU | 638 |
| 1625 | UAAGUUUGGAAGGCUAUAU | 639 | AUAUAGCCUUCCAAACUUA | 640 |
| 1626 | AAGUUUGGAAGGCUAUAUU | 641 | AAUAUAGCCUUCCAAACUU | 642 |
| 1629 | UUUGGAAGGCUAUAUUUCA | 643 | UGAAAUAUAGCCUUCCAAA | 644 |
| 1651 | ACUGAAGUUACAGUAUACU | 645 | AGUAUACUGUAACUUCAGU | 646 |
| 1653 | UGAAGUUACAGUAUACUCA | 647 | UGAGUAUACUGUAACUUCA | 648 |
| 1654 | GAAGUUACAGUAUACUCAA | 649 | UUGAGUAUACUGUAACUUC | 650 |
| 1665 | AUACUCAAGUGAUACACAA | 651 | UUGUGUAUCACUUGAGUAU | 652 |
| 1673 | GUGAUACACAAGCCUAGCA | 653 | UGCUAGGCUUGUGUAUCAC | 654 |
| 1678 | ACACAAGCCUAGCACCCCA | 655 | UGGGGUGCUAGGCUUGUGU | 656 |
| 1693 | CCCACUUUCCACAUAGUGU | 657 | ACACUAUGUGGAAAGUGGG | 658 |
| 1697 | CUUUCCACAUAGUGUUCGA | 659 | UCGAACACUAUGUGGAAAG | 660 |
| 1698 | UUUCCACAUAGUGUUCGAU | 661 | AUCGAACACUAUGUGGAAA | 662 |
| 1699 | UUCCACAUAGUGUUCGAUA | 663 | UAUCGAACACUAUGUGGAA | 664 |
| 1700 | UCCACAUAGUGUUCGAUAA | 665 | UUAUCGAACACUAUGUGGA | 666 |
| 1701 | CCACAUAGUGUUCGAUAAA | 667 | UUUAUCGAACACUAUGUGG | 668 |
| 1705 | AUAGUGUUCGAUAAAGAUU | 669 | AAUCUUUAUCGAACACUAU | 670 |
| 1709 | UGUUCGAUAAAGAUUGAUA | 671 | UAUCAAUCUUUAUCGAACA | 672 |
| 1711 | UUCGAUAAAGAUUGAUAAA | 673 | UUUAUCAAUCUUUAUCGAA | 674 |
| 1721 | AUUGAUAAACUCGAAAUCA | 675 | UGAUUUCGAGUUUAUCAAU | 676 |
| 1723 | UGAUAAACUCGAAAUCACA | 677 | UGUGAUUUCGAGUUUAUCA | 678 |
| 1725 | AUAAACUCGAAAUCACAGA | 679 | UCUGUGAUUUCGAGUUUAU | 680 |
| 1729 | ACUCGAAAUCACAGACCUU | 681 | AAGGUCUGUGAUUUCGAGU | 682 |

TABLE 6A-continued

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 1740 | CAGACCUUUUAAUUCUUAA | 683 | UUAAGAAUUAAAAGGUCUG | 684 |
| 1788 | GGCUUAUUUCUGGUAAGGU | 685 | ACCUUACCAGAAAUAAGCC | 686 |
| 1790 | CUUAUUUCUGGUAAGGUUU | 687 | AAACCUUACCAGAAAUAAG | 688 |
| 1829 | AAUUGUAUUCAUCCGCGCA | 689 | UGCGCGGAUGAAUACAAUU | 690 |
| 1832 | UGUAUUCAUCCGCGCAGCA | 691 | UGCUGCGCGGAUGAAUACA | 692 |
| 1834 | UAUUCAUCCGCGCAGCACA | 693 | UGUGCUGCGCGGAUGAAUA | 694 |
| 1864 | AAAUAAAUGUGAGAGUCGU | 695 | ACGACUCUCACAUUUAUUU | 696 |
| 1866 | AUAAAUGUGAGAGUCGUUA | 697 | UAACGACUCUCACAUUUAU | 698 |
| 1867 | UAAAUGUGAGAGUCGUUAA | 699 | UUAACGACUCUCACAUUUA | 700 |
| 1870 | AUGUGAGAGUCGUUAAUGU | 701 | ACAUUAACGACUCUCACAU | 702 |
| 1873 | UGAGAGUCGUUAAUGUAGU | 703 | ACUACAUUAACGACUCUCA | 704 |
| 1874 | GAGAGUCGUUAAUGUAGUA | 705 | UACUACAUUAACGACUCUC | 706 |
| 1876 | GAGUCGUUAAUGUAGUACU | 707 | AGUACUACAUUAACGACUC | 708 |
| 1884 | AAUGUAGUACUGCUCAUUU | 709 | AAAUGAGCAGUACUACAUU | 710 |
| 1917 | CUUUUCAGGAAUAAUCCCA | 711 | UGGGAUUAUUCCUGAAAAG | 712 |
| 1963 | CAUUGAUUACAUUUAACUU | 713 | AAGUUAAAUGUAAUCAAUG | 714 |
| 1966 | UGAUUACAUUUAACUUGGU | 715 | ACCAAGUUAAAUGUAAUCA | 716 |
| 1972 | CAUUUAACUUGGUAGCCCA | 717 | UGGGCUACCAAGUUAAAUG | 718 |
| 1974 | UUUAACUUGGUAGCCCAAA | 719 | UUUGGGCUACCAAGUUAAA | 720 |
| 1978 | ACUUGGUAGCCCAAAAUUU | 721 | AAAUUUUGGGCUACCAAGU | 722 |
| 1981 | UGGUAGCCCAAAAUUUCUU | 723 | AAGAAAUUUUGGGCUACCA | 724 |
| 1990 | AAAAUUUCUUCAUGGGGUU | 725 | AACCCCAUGAAGAAAUUUU | 726 |
| 2005 | GGUUUUGAACUCGGCGGGA | 727 | UCCCGCCGAGUUCAAAACC | 728 |
| 2006 | GUUUUGAACUCGGCGGGAU | 729 | AUCCCGCCGAGUUCAAAAC | 730 |
| 2007 | UUUUGAACUCGGCGGGAUU | 731 | AAUCCCGCCGAGUUCAAAA | 732 |
| 2008 | UUUGAACUCGGCGGGAUUU | 733 | AAAUCCCGCCGAGUUCAAA | 734 |
| 2012 | AACUCGGCGGGAUUUCAAA | 735 | UUUGAAAUCCCGCCGAGUU | 736 |
| 2079 | UACCUUUAAACUAGGUCGA | 737 | UCGACCUAGUUUAAAGGUA | 738 |
| 2081 | CCUUUAAACUAGGUCGAAA | 739 | UUUCGACCUAGUUUAAAGG | 740 |
| 2090 | UAGGUCGAAACGGGGCGCA | 741 | UGCGCCCCGUUUCGACCUA | 742 |
| 2091 | AGGUCGAAACGGGGCGCAA | 743 | UUGCGCCCCGUUUCGACCU | 744 |
| 2093 | GUCGAAACGGGGCGCAAGA | 745 | UCUUGCGCCCCGUUUCGAC | 746 |
| 2097 | AAACGGGGCGCAAGAGAUU | 747 | AAUCUCUUGCGCCCCGUUU | 748 |
| 2102 | GGGCGCAAGAGAUUGGAUU | 749 | AAUCCAAUCUCUUGCGCCC | 750 |
| 2103 | GGCGCAAGAGAUUGGAUUA | 751 | UAAUCCAAUCUCUUGCGCC | 752 |
| 2104 | GCGCAAGAGAUUGGAUUAA | 753 | UUAAUCCAAUCUCUUGCGC | 754 |
| 2106 | GCAAGAGAUUGGAUUAACA | 755 | UGUUAAUCCAAUCUCUUGC | 756 |

TABLE 6A-continued

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 2109 | AGAGAUUGGAUUAACACCA | 757 | UGGUGUUAAUCCAAUCUCU | 758 |
| 2113 | AUUGGAUUAACACCAUAGU | 759 | ACUAUGGUGUUAAUCCAAU | 760 |
| 2122 | ACACCAUAGUAAUACUUAU | 761 | AUAAGUAUUACUAUGGUGU | 762 |
| 2123 | CACCAUAGUAAUACUUAUU | 763 | AAUAAGUAUUACUAUGGUG | 764 |
| 2130 | GUAAUACUUAUUUUGUUCU | 765 | AGAACAAAAUAAGUAUUAC | 766 |
| 2158 | CAGGGCUUCUUGAAAUAGA | 767 | UCUAUUUCAAGAAGCCCUG | 768 |
| 2171 | AAUAGAGGCUGUAUGGUGU | 769 | ACACCAUACAGCCUCUAUU | 770 |
| 2172 | AUAGAGGCUGUAUGGUGUA | 771 | UACACCAUACAGCCUCUAU | 772 |
| 2179 | CUGUAUGGUGUAAUGGAAA | 773 | UUUCCAUUACACCAUACAG | 774 |
| 2233 | UUCAGUCCCAGUUUUGCGU | 775 | ACGCAAAACUGGGACUGAA | 776 |
| 2235 | CAGUCCCAGUUUUGCGUGA | 777 | UCACGCAAAACUGGGACUG | 778 |
| 2239 | CCCAGUUUUGCGUGACCUU | 779 | AAGGUCACGCAAAACUGGG | 780 |
| 2298 | CUGCAAAAUGAGGAUCGCA | 781 | UGCGAUCCUCAUUUUGCAG | 782 |
| 2305 | AUGAGGAUCGCAAUAGCCA | 783 | UGGCUAUUGCGAUCCUCAU | 784 |
| 2308 | AGGAUCGCAAUAGCCACCU | 785 | AGGUGGCUAUUGCGAUCCU | 786 |
| 2309 | GGAUCGCAAUAGCCACCUU | 787 | AAGGUGGCUAUUGCGAUCC | 788 |
| 2316 | AAUAGCCACCUUGCAACCU | 789 | AGGUUGCAAGGUGGCUAUU | 790 |
| 2321 | CCACCUUGCAACCUUGACU | 791 | AGUCAAGGUUGCAAGGUGG | 792 |
| 2328 | GCAACCUUGACUGGAGCGA | 793 | UCGCUCCAGUCAAGGUUGC | 794 |
| 2338 | CUGGAGCGAGCCUCGCACA | 795 | UGUGCGAGGCUCGCUCCAG | 796 |
| 2382 | AGCCAUGAUUACGCCGCCU | 797 | AGGCGGCGUAAUCAUGGCU | 798 |
| 2383 | GCCAUGAUUACGCCGCCUU | 799 | AAGGCGGCGUAAUCAUGGC | 800 |
| 2435 | UCCAGCAGGUGUAGGCGCU | 801 | AGCGCCUACACCUGCUGGA | 802 |
| 2573 | AGGGAAAGCGGGCGACCCA | 803 | UGGGUCGCCCGCUUUCCCU | 804 |
| 2576 | GAAAGCGGGCGACCCACCU | 805 | AGGUGGGUCGCCCGCUUUC | 806 |
| 2761 | GAGCGAGUGGCGCCCGUAU | 807 | AUACGGGCGCCACUCGCUC | 808 |
| 2766 | AGUGGCGCCCGUAUGCCCU | 809 | AGGGCAUACGGGCGCCACU | 810 |
| 2885 | CAGGUUGCCAUUCGCCGCA | 811 | UGCGGCGAAUGGCAACCUG | 812 |
| 2887 | GGUUGCCAUUCGCCGCACA | 813 | UGUGCGGCGAAUGGCAACC | 814 |
| 2895 | UUCGCCGCACAGGCCCUAU | 815 | AUAGGGCCUGUGCGGCGAA | 816 |
| 2896 | UCGCCGCACAGGCCCUAUU | 817 | AAUAGGGCCUGUGCGGCGA | 818 |
| 3033 | GCGGGUGCAUGGCGCAGUA | 819 | UACUGCGCCAUGCACCCGC | 820 |
| 3034 | CGGGUGCAUGGCGCAGUAA | 821 | UUACUGCGCCAUGCACCCG | 822 |
| 3042 | UGGCGCAGUAACGGCCCCU | 823 | AGGGGCCGUUACUGCGCCA | 824 |
| 3043 | GGCGCAGUAACGGCCCCUA | 825 | UAGGGGCCGUUACUGCGCC | 826 |
| 3473 | ACGCGGCCAAGGGAAAAGU | 827 | ACUUUUCCCUUGGCCGCGU | 828 |
| 3608 | CCCGCUCAUCGCUGUUCCA | 829 | UGGAACAGCGAUGAGCGGG | 830 |

TABLE 6A-continued

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 3626 | AGGAGAAGGCGAACCUGUA | 831 | UACAGGUUCGCCUUCUCCU | 832 |
| 3650 | CAAGCAACACGCCCGGGGA | 833 | UCCCCGGGCGUGUUGCUUG | 834 |
| 3695 | GGCCCAACGGGCAGACGAA | 835 | UUCGUCUGCCCGUUGGGCC | 836 |
| 3731 | AGCUGGCGCUCGAGUACAU | 837 | AUGUACUCGAGCGCCAGCU | 838 |
| 3734 | UGGCGCUCGAGUACAUCGU | 839 | ACGAUGUACUCGAGCGCCA | 840 |
| 3739 | CUCGAGUACAUCGUGCCGU | 841 | ACGGCACGAUGUACUCGAG | 842 |
| 3745 | UACAUCGUGCCGUGCAUGA | 843 | UCAUGCACGGCACGAUGUA | 844 |
| 3748 | AUCGUGCCGUGCAUGAACA | 845 | UGUUCAUGCACGGCACGAU | 846 |
| 3752 | UGCCGUGCAUGAACAAGCA | 847 | UGCUUGUUCAUGCACGGCA | 848 |
| 3762 | GAACAAGCACGGCAUCUGU | 849 | ACAGAUGCCGUGCUUGUUC | 850 |
| 3797 | UCGGCAAGGAGACCGGACA | 851 | UGUCCGGUCUCCUUGCCGA | 852 |
| 3809 | CCGGACAGCAGAUCGGCGA | 853 | UCGCCGAUCUGCUGUCCGG | 854 |
| 3842 | UGCACGACACCGGGAAGUU | 855 | AACUUCCCGGUGUCGUGCA | 856 |
| 3854 | GGAAGUUCACGGACGGGCA | 857 | UGCCCGUCCGUGAACUUCC | 858 |
| 3901 | AAGGACAUCCGAGGCGAUA | 859 | UAUCGCCUCGGAUGUCCUU | 860 |
| 3902 | AGGACAUCCGAGGCGAUAA | 861 | UUAUCGCCUCGGAUGUCCU | 862 |
| 3904 | GACAUCCGAGGCGAUAAGA | 863 | UCUUAUCGCCUCGGAUGUC | 864 |
| 3905 | ACAUCCGAGGCGAUAAGAU | 865 | AUCUUAUCGCCUCGGAUGU | 866 |
| 3907 | AUCCGAGGCGAUAAGAUCA | 867 | UGAUCUUAUCGCCUCGGAU | 868 |
| 3913 | GGCGAUAAGAUCACCUGGA | 869 | UCCAGGUGAUCUUAUCGCC | 870 |
| 3917 | AUAAGAUCACCUGGAUCGA | 871 | UCGAUCCAGGUGAUCUUAU | 872 |
| 3922 | AUCACCUGGAUCGAGGGCA | 873 | UGCCCUCGAUCCAGGUGAU | 874 |
| 3939 | CAAGGAGCCCGGCUGCGAA | 875 | UUCGCAGCCGGGCUCCUUG | 876 |
| 3943 | GAGCCCGGCUGCGAAACCA | 877 | UGGUUUCGCAGCCGGGCUC | 878 |
| 3944 | AGCCCGGCUGCGAAACCAU | 879 | AUGGUUUCGCAGCCGGGCU | 880 |
| 3950 | GCUGCGAAACCAUUGGGCU | 881 | AGCCCAAUGGUUUCGCAGC | 882 |
| 3953 | GCGAAACCAUUGGGCUGCU | 883 | AGCAGCCCAAUGGUUUCGC | 884 |
| 3978 | CAGCAUGGACGACCUGAUA | 885 | UAUCAGGUCGUCCAUGCUG | 886 |
| 3983 | UGGACGACCUGAUACGCCA | 887 | UGGCGUAUCAGGUCGUCCA | 888 |
| 3987 | CGACCUGAUACGCCACUGU | 889 | ACAGUGGCGUAUCAGGUCG | 890 |
| 3988 | GACCUGAUACGCCACUGUA | 891 | UACAGUGGCGUAUCAGGUC | 892 |
| 3994 | AUACGCCACUGUAACGGGA | 893 | UCCCGUUACAGUGGCGUAU | 894 |
| 4024 | UACAAAAUCAAUGGCCGGA | 895 | UCCGGCCAUUGAUUUUGUA | 896 |
| 4028 | AAAUCAAUGGCCGGACGAA | 897 | UUCGUCCGGCCAUUGAUUU | 898 |
| 4029 | AAUCAAUGGCCGGACGAAA | 899 | UUUCGUCCGGCCAUUGAUU | 900 |
| 4033 | AAUGGCCGGACGAAAGCCA | 901 | UGGCUUUCGUCCGGCCAUU | 902 |
| 4037 | GCCGGACGAAAGCCAUGGU | 903 | ACCAUGGCUUUCGUCCGGC | 904 |

TABLE 6A-continued

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 4038 | CCGGACGAAAGCCAUGGUU | 905 | AACCAUGGCUUUCGUCCGG | 906 |
| 4047 | AGCCAUGGUUGCUUGUUAU | 907 | AUAACAAGCAACCAUGGCU | 908 |
| 4054 | GUUGCUUGUUAUCCGGGCA | 909 | UGCCCGGAUAACAAGCAAC | 910 |
| 4055 | UUGCUUGUUAUCCGGGCAA | 911 | UUGCCCGGAUAACAAGCAA | 912 |
| 4066 | CCGGGCAAUGGAACGGGUU | 913 | AACCCGUUCCAUUGCCCGG | 914 |
| 4067 | CGGGCAAUGGAACGGGUUA | 915 | UAACCCGUUCCAUUGCCCG | 916 |
| 4068 | GGGCAAUGGAACGGGUUAU | 917 | AUAACCCGUUCCAUUGCCC | 918 |
| 4070 | GCAAUGGAACGGGUUAUGU | 919 | ACAUAACCCGUUCCAUUGC | 920 |
| 4076 | GAACGGGUUAUGUACGUCA | 921 | UGACGUACAUAACCCGUUC | 922 |
| 4077 | AACGGGUUAUGUACGUCAU | 923 | AUGACGUACAUAACCCGUU | 924 |
| 4079 | CGGGUUAUGUACGUCAUGU | 925 | ACAUGACGUACAUAACCCG | 926 |
| 4080 | GGGUUAUGUACGUCAUGUU | 927 | AACAUGACGUACAUAACCC | 928 |
| 4082 | GUUAUGUACGUCAUGUUGA | 929 | UCAACAUGACGUACAUAAC | 930 |
| 4084 | UAUGUACGUCAUGUUGAUA | 931 | UAUCAACAUGACGUACAUA | 932 |
| 4085 | AUGUACGUCAUGUUGAUAA | 933 | UUAUCAACAUGACGUACAU | 934 |
| 4089 | ACGUCAUGUUGAUAAUCCA | 935 | UGGAUUAUCAACAUGACGU | 936 |
| 4090 | CGUCAUGUUGAUAAUCCAA | 937 | UUGGAUUAUCAACAUGACG | 938 |
| 4113 | AGAUGGAAGAUGUGUGACA | 939 | UGUCACACAUCUUCCAUCU | 940 |
| 4127 | UGACAUGUAUAUAUUAUCU | 941 | AGAUAAUAUAUACAUGUCA | 942 |
| 4153 | GACUGGGAUGCCAAGGUAA | 943 | UUACCUUGGCAUCCCAGUC | 944 |
| 4163 | CCAAGGUAAGUGGAGGUAU | 945 | AUACCUCCACUUACCUUGG | 946 |
| 4172 | GUGGAGGUAUACUUCGAAU | 947 | AUUCGAAGUAUACCUCCAC | 948 |
| 4173 | UGGAGGUAUACUUCGAAUU | 949 | AAUUCGAAGUAUACCUCCA | 950 |
| 4174 | GGAGGUAUACUUCGAAUUU | 951 | AAAUUCGAAGUAUACCUCC | 952 |
| 4175 | GAGGUAUACUUCGAAUUUU | 953 | AAAAUUCGAAGUAUACCUC | 954 |
| 4252 | UUCUGGUCUGACCGUCGCA | 955 | UGCGACGGUCAGACCAGAA | 956 |
| 4253 | UCUGGUCUGACCGUCGCAA | 957 | UUGCGACGGUCAGACCAGA | 958 |
| 4257 | GUCUGACCGUCGCAACCCU | 959 | AGGGUUGCGACGGUCAGAC | 960 |
| 4269 | CAACCCUCAUGAAGUACAA | 961 | UUGUACUUCAUGAGGGUUG | 962 |
| 4294 | UAUGCUACAAGGUACGCAA | 963 | UUGCGUACCUUGUAGCAUA | 964 |
| 4295 | AUGCUACAAGGUACGCAAU | 965 | AUUGCGUACCUUGUAGCAU | 966 |
| 4296 | UGCUACAAGGUACGCAAUA | 967 | UAUUGCGUACCUUGUAGCA | 968 |
| 4297 | GCUACAAGGUACGCAAUAA | 969 | UUAUUGCGUACCUUGUAGC | 970 |
| 4299 | UACAAGGUACGCAAUAACU | 971 | AGUUAUUGCGUACCUUGUA | 972 |
| 4306 | UACGCAAUAACUGUUUGGU | 973 | ACCAAACAGUUAUUGCGUA | 974 |
| 4307 | ACGCAAUAACUGUUUGGUA | 975 | UACCAAACAGUUAUUGCGU | 976 |
| 4335 | AGAUGAGAGAGCACGAGCU | 977 | AGCUCGUGCUCUCUCAUCU | 978 |

TABLE 6A-continued

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 4337 | AUGAGAGAGCACGAGCUAA | 979 | UUAGCUCGUGCUCUCUCAU | 980 |
| 4340 | AGAGAGCACGAGCUAAAGU | 981 | ACUUUAGCUCGUGCUCUCU | 982 |
| 4341 | GAGAGCACGAGCUAAAGUA | 983 | UACUUUAGCUCGUGCUCUC | 984 |
| 4342 | AGAGCACGAGCUAAAGUAA | 985 | UUACUUUAGCUCGUGCUCU | 986 |
| 4356 | AGUAAAAUAUCUAACAGGU | 987 | ACCUGUUAGAUAUUUUACU | 988 |
| 4358 | UAAAAUAUCUAACAGGUGA | 989 | UCACCUGUUAGAUAUUUUA | 990 |
| 4359 | AAAAUAUCUAACAGGUGAA | 991 | UUCACCUGUUAGAUAUUUU | 992 |
| 4360 | AAAUAUCUAACAGGUGAAA | 993 | UUUCACCUGUUAGAUAUUU | 994 |
| 4379 | AAGGUGUGAGGGUUGAACU | 995 | AGUUCAACCCUCACACCUU | 996 |
| 4381 | GGUGAGGGUUGAACUCA | 997 | UGAGUUCAACCCUCACACC | 998 |
| 4384 | GUGAGGGUUGAACUCAAUA | 999 | UAUUGAGUUCAACCCUCAC | 1000 |
| 4386 | GAGGGUUGAACUCAAUAAA | 1001 | UUUAUUGAGUUCAACCCUC | 1002 |
| 4389 | GGUUGAACUCAAUAAACCU | 1003 | AGGUUUAUUGAGUUCAACC | 1004 |
| 4404 | ACCUUCAGAUUCGGUCGGU | 1005 | ACCGACCGAAUCUGAAGGU | 1006 |
| 4405 | CCUUCAGAUUCGGUCGGUA | 1007 | UACCGACCGAAUCUGAAGG | 1008 |
| 4406 | CUUCAGAUUCGGUCGGUAA | 1009 | UUACCGACCGAAUCUGAAG | 1010 |
| 4407 | UUCAGAUUCGGUCGGUAAA | 1011 | UUUACCGACCGAAUCUGAA | 1012 |
| 4409 | CAGAUUCGGUCGGUAAAGA | 1013 | UCUUUACCGACCGAAUCUG | 1014 |
| 4412 | AUUCGGUCGGUAAAGACGU | 1015 | ACGUCUUUACCGACCGAAU | 1016 |
| 4424 | AAGACGUCUUCUAGAGCCU | 1017 | AGGCUCUAGAAGACGUCUU | 1018 |
| 4425 | AGACGUCUUCUAGAGCCUU | 1019 | AAGGCUCUAGAAGACGUCU | 1020 |
| 4435 | UAGAGCCUUUGAUCCAGCA | 1021 | UGCUGGAUCAAAGGCUCUA | 1022 |
| 4443 | UUGAUCCAGCAAUACCCA | 1023 | UGGGGUAUUGCUGGAUCAA | 1024 |
| 4451 | GCAAUACCCCACUUCACCU | 1025 | AGGUGAAGUGGGGUAUUGC | 1026 |
| 4461 | ACUUCACCUACAAUAUUGU | 1027 | ACAAUAUUGUAGGUGAAGU | 1028 |
| 4488 | UGUUAACUUGUGAAUACGA | 1029 | UCGUAUUCACAAGUUAACA | 1030 |
| 4489 | GUUAACUUGUGAAUACGAA | 1031 | UUCGUAUUCACAAGUUAAC | 1032 |
| 4494 | CUUGUGAAUACGAAUAAAU | 1033 | AUUUAUUCGUAUUCACAAG | 1034 |
| 4502 | UACGAAUAAAUGGGAUAAA | 1035 | UUUAUCCCAUUUAUUCGUA | 1036 |
| 4525 | AAUAGACAACCAGUUCGCA | 1037 | UGCGAACUGGUUGUCUAUU | 1038 |
| 4526 | AUAGACAACCAGUUCGCAU | 1039 | AUGCGAACUGGUUGUCUAU | 1040 |
| 4527 | UAGACAACCAGUUCGCAUU | 1041 | AAUGCGAACUGGUUGUCUA | 1042 |
| 4528 | AGACAACCAGUUCGCAUUU | 1043 | AAAUGCGAACUGGUUGUCU | 1044 |
| 4608 | CUUUGUACUGCAUGAUCAA | 1045 | UUGAUCAUGCAGUACAAAG | 1046 |
| 4634 | UCUGUGAUUGCUUACAGGA | 1047 | UCCUGUAAGCAAUCACAGA | 1048 |
| 4651 | GAGGAAGAUAAGCUACUAA | 1049 | UUAGUAGCUUAUCUUCCUC | 1050 |
| 4687 | AUCUGGAUAUGAAAUAAGU | 1051 | ACUUAUUUCAUAUCCAGAU | 1052 |

TABLE 6A-continued

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 4699 | AAUAAGUGCCCUGUGUAGA | 1053 | UCUACACAGGGCACUUAUU | 1054 |
| 4700 | AUAAGUGCCCUGUGUAGAA | 1055 | UUCUACACAGGGCACUUAU | 1056 |
| 4703 | AGUGCCCUGUGUAGAAUUU | 1057 | AAAUUCUACACAGGGCACU | 1058 |
| 4732 | UAUAUUUUGCCAGAUCUGU | 1059 | ACAGAUCUGGCAAAAUAUA | 1060 |
| 4738 | UUGCCAGAUCUGUUAUCUA | 1061 | UAGAUAACAGAUCUGGCAA | 1062 |
| 4741 | CCAGAUCUGUUAUCUAGCU | 1063 | AGCUAGAUAACAGAUCUGG | 1064 |
| 4748 | UGUUAUCUAGCUGAGUUCA | 1065 | UGAACUCAGCUAGAUAACA | 1066 |
| 4749 | GUUAUCUAGCUGAGUUCAU | 1067 | AUGAACUCAGCUAGAUAAC | 1068 |
| 4756 | AGCUGAGUUCAUUUCAUCU | 1069 | AGAUGAAAUGAACUCAGCU | 1070 |
| 4791 | AAGUUUGAAUUUGGGAUAA | 1071 | UUAUCCCAAAUUCAAACUU | 1072 |
| 4812 | UUUCUAUAUUAGGUACAAU | 1073 | AUUGUACCUAAUAUAGAAA | 1074 |
| 4814 | UCUAUAUUAGGUACAAUUU | 1075 | AAAUUGUACCUAAUAUAGA | 1076 |
| 4819 | AUUAGGUACAAUUUAUCUA | 1077 | UAGAUAAAUUGUACCUAAU | 1078 |
| 4820 | UUAGGUACAAUUUAUCUAA | 1079 | UUAGAUAAAUUGUACCUAA | 1080 |
| 4821 | UAGGUACAAUUUAUCUAAA | 1081 | UUUAGAUAAAUUGUACCUA | 1082 |
| 4823 | GGUACAAUUUAUCUAAACU | 1083 | AGUUUAGAUAAAUUGUACC | 1084 |
| 4870 | CUCAAAAUAACAUCAAUCU | 1085 | AGAUUGAUGUUAUUUUGAG | 1086 |
| 4893 | UUGUAAACCUGUUCAUACU | 1087 | AGUAUGAACAGGUUUACAA | 1088 |
| 4894 | UGUAAACCUGUUCAUACUA | 1089 | UAGUAUGAACAGGUUUACA | 1090 |
| 4897 | AAACCUGUUCAUACUAUUA | 1091 | UAAUAGUAUGAACAGGUUU | 1092 |
| 4909 | ACUAUUAAAUUUGCCCUA | 1093 | UAGGGCAAAUUUAAUAGU | 1094 |
| 4919 | UUUGCCCUAAAAGACCUCU | 1095 | AGAGGUCUUUUAGGGCAAA | 1096 |
| 4920 | UUGCCCUAAAAGACCUCUU | 1097 | AAGAGGUCUUUUAGGGCAA | 1098 |
| 4929 | AAGACCUCUUAAUAAUGAU | 1099 | AUCAUUAUUAAGAGGUCUU | 1100 |
| 4930 | AGACCUCUUAAUAAUGAUU | 1101 | AAUCAUUAUUAAGAGGUCU | 1102 |
| 4933 | CCUCUUAAUAAUGAUUGUU | 1103 | AACAAUCAUUAUUAAGAGG | 1104 |
| 4952 | GCCAGUGACUGAUGAUUAA | 1105 | UUAAUCAUCAGUCACUGGC | 1106 |
| 4953 | CCAGUGACUGAUGAUUAAU | 1107 | AUUAAUCAUCAGUCACUGG | 1108 |
| 4954 | CAGUGACUGAUGAUUAAUU | 1109 | AAUUAAUCAUCAGUCACUG | 1110 |
| 4997 | GAGCACUUUAAUUACAACU | 1111 | AGUUGUAAUUAAAGUGCUC | 1112 |
| 5031 | UUUGUAGUCCUUCCUUACA | 1113 | UGUAAGGAAGGACUACAAA | 1114 |
| 5035 | UAGUCCUUCCUUACACUAA | 1115 | UUAGUGUAAGGAAGGACUA | 1116 |
| 5048 | CACUAAUUUGAACUGUUAA | 1117 | UUAACAGUUCAAAUUAGUG | 1118 |
| 5084 | UUGACAUUGUCAAUAACGA | 1119 | UCGUUAUUGACAAUGUCAA | 1120 |
| 5085 | UGACAUUGUCAAUAACGAA | 1121 | UUCGUUAUUGACAAUGUCA | 1122 |
| 5086 | GACAUUGUCAAUAACGAAA | 1123 | UUUCGUUAUUGACAAUGUC | 1124 |
| 5089 | AUUGUCAAUAACGAAACCU | 1125 | AGGUUUCGUUAUUGACAAU | 1126 |

TABLE 6A-continued

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 5090 | UUGUCAAUAACGAAACCUA | 1127 | UAGGUUUCGUUAUUGACAA | 1128 |
| 5091 | UGUCAAUAACGAAACCUAA | 1129 | UUAGGUUUCGUUAUUGACA | 1130 |
| 5095 | AAUAACGAAACCUAAUUGU | 1131 | ACAAUUAGGUUUCGUUAUU | 1132 |
| 5096 | AUAACGAAACCUAAUUGUA | 1133 | UACAAUUAGGUUUCGUUAU | 1134 |
| 5105 | CCUAAUUGUAAAACAGUCA | 1135 | UGACUGUUUUACAAUUAGG | 1136 |
| 5111 | UGUAAAACAGUCACCAUUU | 1137 | AAAUGGUGACUGUUUUACA | 1138 |
| 5120 | GUCACCAUUUACUACCAAU | 1139 | AUUGGUAGUAAAUGGUGAC | 1140 |
| 5121 | UCACCAUUUACUACCAAUA | 1141 | UAUUGGUAGUAAAUGGUGA | 1142 |
| 5122 | CACCAUUUACUACCAAUAA | 1143 | UUAUUGGUAGUAAAUGGUG | 1144 |
| 5124 | CCAUUUACUACCAAUAACU | 1145 | AGUUAUUGGUAGUAAAUGG | 1146 |
| 5399 | CCUAGGCUGGGGUUUAAGU | 1147 | ACUUAAACCCCAGCCUAGG | 1148 |
| 5404 | GCUGGGGUUUAAGUUAAAU | 1149 | AUUUAACUUAAACCCCAGC | 1150 |
| 5405 | CUGGGGUUUAAGUUAAAUU | 1151 | AAUUUAACUUAAACCCCAG | 1152 |
| 5432 | AACUAAAGUGACUGGCACU | 1153 | AGUGCCAGUCACUUUAGUU | 1154 |
| 5474 | GCUUCAAGUUCCUAAGAUA | 1155 | UAUCUUAGGAACUUGAAGC | 1156 |
| 5481 | GUUCCUAAGAUAAGGGCUU | 1157 | AAGCCCUUAUCUUAGGAAC | 1158 |
| 5484 | CCUAAGAUAAGGGCUUUCU | 1159 | AGAAAGCCCUUAUCUUAGG | 1160 |
| 5511 | CAGGUGUAUGUAUCCUCUA | 1161 | UAGAGGAUACAUACACCUG | 1162 |
| 5513 | GGUGUAUGUAUCCUCUAGA | 1163 | UCUAGAGGAUACAUACACC | 1164 |
| 5517 | UAUGUAUCCUCUAGAUGUA | 1165 | UACAUCUAGAGGAUACAUA | 1166 |
| 5523 | UCCUCUAGAUGUAGACAAU | 1167 | AUUGUCUACAUCUAGAGGA | 1168 |
| 5524 | CCUCUAGAUGUAGACAAUA | 1169 | UAUUGUCUACAUCUAGAGG | 1170 |
| 5543 | AUGUCCCAUUUCUAAGUCU | 1171 | AGACUUAGAAAUGGGACAU | 1172 |
| 5544 | UGUCCCAUUUCUAAGUCUU | 1173 | AAGACUUAGAAAUGGGACA | 1174 |
| 5574 | UCUCCUUAAAUUGAUUGUA | 1175 | UACAAUCAAUUUAAGGAGA | 1176 |
| 5580 | UAAAUUGAUUGUACUUCCA | 1177 | UGGAAGUACAAUCAAUUUA | 1178 |
| 5581 | AAAUUGAUUGUACUUCCAA | 1179 | UUGGAAGUACAAUCAAUUU | 1180 |
| 5624 | AUACUGUGAUCUAUCUGAU | 1181 | AUCAGAUAGAUCACAGUAU | 1182 |
| 5659 | UGUCUCUGUUGAAGAGCAU | 1183 | AUGCUCUUCAACAGAGACA | 1184 |
| 5662 | CUCUGUUGAAGAGCAUCAA | 1185 | UUGAUGCUCUUCAACAGAG | 1186 |
| 5673 | AGCAUCAAGGGGAGAUUAU | 1187 | AUAAUCUCCCCUUGAUGCU | 1188 |
| 5676 | AUCAAGGGGAGAUUAUGUA | 1189 | UACAUAAUCUCCCCUUGAU | 1190 |
| 5678 | CAAGGGGAGAUUAUGUACA | 1191 | UGUACAUAAUCUCCCCUUG | 1192 |
| 5711 | UGUGGUGUUACUGACGGAA | 1193 | UUCCGUCAGUAACACCACA | 1194 |
| 5714 | GGUGUUACUGACGGAAUGU | 1195 | ACAUUCCGUCAGUAACACC | 1196 |
| 5717 | GUUACUGACGGAAUGUGCA | 1197 | UGCACAUUCCGUCAGUAAC | 1198 |
| 5723 | GACGGAAUGUGCAGUAACU | 1199 | AGUUACUGCACAUUCCGUC | 1200 |

TABLE 6A-continued

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 5738 | AACUCCUCAGAUAUCUGUU | 1201 | AACAGAUAUCUGAGGAGUU | 1202 |
| 5740 | CUCCUCAGAUAUCUGUUAA | 1203 | UUAACAGAUAUCUGAGGAG | 1204 |
| 5782 | GCCUUCUUACCUGUACUGA | 1205 | UCAGUACAGGUAAGAAGGC | 1206 |
| 5792 | CUGUACUGAAAGAUGCUUA | 1207 | UAAGCAUCUUUCAGUACAG | 1208 |
| 5795 | UACUGAAAGAUGCUUAGCU | 1209 | AGCUAAGCAUCUUUCAGUA | 1210 |
| 5799 | GAAAGAUGCUUAGCUUAGA | 1211 | UCUAAGCUAAGCAUCUUUC | 1212 |
| 5801 | AAGAUGCUUAGCUUAGAAA | 1213 | UUUCUAAGCUAAGCAUCUU | 1214 |
| 5860 | UCAUGGGUUUUCUUAUUUA | 1215 | UAAAUAAGAAAACCCAUGA | 1216 |
| 5915 | AAGGCCUCACAUACAUGUU | 1217 | AACAUGUAUGUGAGGCCUU | 1218 |
| 5917 | GGCCUCACAUACAUGUUAU | 1219 | AUAACAUGUAUGUGAGGCC | 1220 |
| 5918 | GCCUCACAUACAUGUUAUU | 1221 | AAUAACAUGUAUGUGAGGC | 1222 |
| 5944 | UGAAUGGGACGGAUGUCU | 1223 | AGACAUCCGUCCCAAUUCA | 1224 |
| 5945 | GAAUUGGGACGGAUGUCUU | 1225 | AAGACAUCCGUCCCAAUUC | 1226 |
| 5948 | UUGGGACGGAUGUCUUAGA | 1227 | UCUAAGACAUCCGUCCCAA | 1228 |
| 5950 | GGGACGGAUGUCUUAGACU | 1229 | AGUCUAAGACAUCCGUCCC | 1230 |
| 5961 | CUUAGACUUCACUUUCCUA | 1231 | UAGGAAAGUGAAGUCUAAG | 1232 |
| 5965 | GACUUCACUUUCCUAGGCU | 1233 | AGCCUAGGAAAGUGAAGUC | 1234 |
| 5966 | ACUUCACUUUCCUAGGCUU | 1235 | AAGCCUAGGAAAGUGAAGU | 1236 |
| 5967 | CUUCACUUUCCUAGGCUUU | 1237 | AAAGCCUAGGAAAGUGAAG | 1238 |
| 5968 | UUCACUUUCCUAGGCUUUU | 1239 | AAAAGCCUAGGAAAGUGAA | 1240 |
| 5994 | ACCUAAAGGGUGGUAUCCA | 1241 | UGGAUACCACCCUUUAGGU | 1242 |
| 5997 | UAAAGGGUGGUAUCCAUAU | 1243 | AUAUGGAUACCACCCUUUA | 1244 |
| 5998 | AAAGGGUGGUAUCCAUAUU | 1245 | AAUAUGGAUACCACCCUUU | 1246 |
| 6004 | UGGUAUCCAUAUUUGCGU | 1247 | ACGCAAAAUAUGGAUACCA | 1248 |
| 6006 | GUAUCCAUAUUUGCGUGA | 1249 | UCACGCAAAAUAUGGAUAC | 1250 |
| 6007 | UAUCCAUAUUUGCGUGAA | 1251 | UUCACGCAAAAUAUGGAUA | 1252 |
| 6008 | AUCCAUAUUUGCGUGAAU | 1253 | AUUCACGCAAAAUAUGGAU | 1254 |
| 6010 | CCAUAUUUGCGUGAAUUA | 1255 | UAAUUCACGCAAAAUAUGG | 1256 |
| 6017 | UUGCGUGAAUUAUGGGUGU | 1257 | ACACCCAUAAUUCACGCAA | 1258 |
| 6024 | AAUUAUGGGUGUAAGACCU | 1259 | AGGUCUUACACCCAUAAUU | 1260 |
| 6025 | AUUAUGGGUGUAAGACCUU | 1261 | AAGGUCUUACACCCAUAAU | 1262 |
| 6038 | GACCUUGCCCACUUAGGUU | 1263 | AACCUAAGUGGGCAAGGUC | 1264 |
| 6048 | ACUUAGGUUUUCUAUCUCU | 1265 | AGAGAUAGAAAACCUAAGU | 1266 |
| 6050 | UUAGGUUUUCUAUCUCUGU | 1267 | ACAGAGAUAGAAAACCUAA | 1268 |
| 6057 | UUCUAUCUCUGUCCUUGAU | 1269 | AUCAAGGACAGAGAUAGAA | 1270 |
| 6059 | CUAUCUCUGUCCUUGAUCU | 1271 | AGAUCAAGGACAGAGAUAG | 1272 |
| 6083 | GCCAAAAUGUGAGUAUACA | 1273 | UGUAUACUCACAUUUUGGC | 1274 |

TABLE 6A-continued

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 6085 | CAAAAUGUGAGUAUACAGA | 1275 | UCUGUAUACUCACAUUUUG | 1276 |
| 6137 | AGCAUCUGUAUAGUUUGUA | 1277 | UACAAACUAUACAGAUGCU | 1278 |
| 6153 | GUAUUCAAUUUGAGACCUU | 1279 | AAGGUCUCAAAUUGAAUAC | 1280 |
| 6167 | ACCUUUCUAUGGGAAGCU | 1281 | AGCUUCCCAUAGAAAAGGU | 1282 |
| 6169 | CUUUUCUAUGGGAAGCUCA | 1283 | UGAGCUUCCCAUAGAAAAG | 1284 |
| 6206 | UUGCCAUUGCUAUUCAUGU | 1285 | ACAUGAAUAGCAAUGGCAA | 1286 |
| 6273 | GGGAUUGAAUGUUCAGUAU | 1287 | AUACUGAACAUUCAAUCCC | 1288 |
| 6290 | AUAGUGAUCUCACUUAGGA | 1289 | UCCUAAGUGAGAUCACUAU | 1290 |
| 6318 | GGAGAAAGUGAUAGUUUAU | 1291 | AUAAACUAUCACUUUCUCC | 1292 |
| 6341 | UUUUCCUCGCCCAUAUUCA | 1293 | UGAAUAUGGGCGAGGAAAA | 1294 |
| 6344 | UCCUCGCCCAUAUUCAGUU | 1295 | AACUGAAUAUGGGCGAGGA | 1296 |
| 6345 | CCUCGCCCAUAUUCAGUUU | 1297 | AAACUGAAUAUGGGCGAGG | 1298 |
| 6346 | CUCGCCCAUAUUCAGUUUU | 1299 | AAAACUGAAUAUGGGCGAG | 1300 |
| 6348 | CGCCCAUAUUCAGUUUUGU | 1301 | ACAAAACUGAAUAUGGGCG | 1302 |
| 6389 | AGAUGAUAACAUCACAUCU | 1303 | AGAUGUGAUGUUAUCAUCU | 1304 |
| 6400 | UCACAUCUCUACAGUAAGU | 1305 | ACUUACUGUAGAGAUGUGA | 1306 |
| 6431 | CCAACCCAGGAGCGCAAGU | 1307 | ACUUGCGCUCCUGGGUUGG | 1308 |
| 6432 | CAACCCAGGAGCGCAAGUU | 1309 | AACUUGCGCUCCUGGGUUG | 1310 |
| 6458 | CCAUCGGUCUAUAGUACA | 1311 | UGUACUAUAGACCAGAUGG | 1312 |
| 6469 | AUAGUACAGUGCGCGGCGU | 1313 | ACGCCGCGCACUGUACUAU | 1314 |
| 6470 | UAGUACAGUGCGCGGCGUU | 1315 | AACGCCGCGCACUGUACUA | 1316 |
| 6471 | AGUACAGUGCGCGGCGUUA | 1317 | UAACGCCGCGCACUGUACU | 1318 |
| 6476 | AGUGCGCGGCGUUAGGCCA | 1319 | UGGCCUAACGCCGCGCACU | 1320 |
| 6478 | UGCGCGGCGUUAGGCCACA | 1321 | UGUGGCCUAACGCCGCGCA | 1322 |
| 6479 | GCGCGGCGUUAGGCCACAA | 1323 | UUGUGGCCUAACGCCGCGC | 1324 |
| 6484 | GCGUUAGGCCACAACUCAA | 1325 | UUGAGUUGUGGCCUAACGC | 1326 |
| 6485 | CGUUAGGCCACAACUCAAA | 1327 | UUUGAGUUGUGGCCUAACG | 1328 |
| 6516 | UUUAGGGUUAGUAGAAAUU | 1329 | AAUUUCUACUAACCCUAAA | 1330 |
| 6537 | UUUAUGUUGAUGGGAGGUU | 1331 | AACCUCCCAUCAACAUAAA | 1332 |
| 6548 | GGGAGGUUUGUUUGAUUGU | 1333 | ACAAUCAAACAAACCUCCC | 1334 |
| 6581 | ACAGCCUUUUAAUUUGGGA | 1335 | UCCCAAAUUAAAAGGCUGU | 1336 |
| 6599 | AGCCCUGUUGUCAUUCAA | 1337 | UUGAAUGACAACAGGGGCU | 1338 |
| 6609 | GUCAUUCAAAUGUGUACCU | 1339 | AGGUACACAUUUGAAUGAC | 1340 |
| 6612 | AUUCAAAUGUGUACCUCUA | 1341 | UAGAGGUACACAUUUGAAU | 1342 |
| 6656 | CUAUCUGUGGGUUGUGCUU | 1343 | AAGCACAACCCACAGAUAG | 1344 |
| 6669 | GUGCUUGCCAGACAGGUCU | 1345 | AGACCUGUCUGGCAAGCAC | 1346 |
| 6716 | UAUACUCUCUUAGGAAUCA | 1347 | UGAUUCCUAAGAGAGUAUA | 1348 |

TABLE 6A-continued

Human EGNL1 Single Strands and Duplex Sequences

| Start | Sense Sequence (5' to 3') | SEQ ID NO. | Antisense Sequence (5' to 3') | SEQ ID NO. |
|---|---|---|---|---|
| 6747 | CAAGAAAUCAGGAUGGCCA | 1349 | UGGCCAUCCUGAUUUCUUG | 1350 |
| 6788 | CAUGUUAGUGGGACUAUUA | 1351 | UAAUAGUCCCACUAACAUG | 1352 |
| 6800 | ACUAUUAACUUGUCACCAA | 1353 | UUGGUGACAAGUUAAUAGU | 1354 |
| 6862 | AUAUGUGUUUAAUCCUGGU | 1355 | ACCAGGAUUAAACACAUAU | 1356 |
| 6868 | GUUUAAUCCUGGUUAAAGA | 1357 | UCUUUAACCAGGAUUAAAC | 1358 |
| 6869 | UUUAAUCCUGGUUAAAGAU | 1359 | AUCUUUAACCAGGAUUAAA | 1360 |
| 6911 | UUCAACACAUUAACCAGCU | 1361 | AGCUGGUUAAUGUGUUGAA | 1362 |
| 6942 | CCUUUAUCAAGAGUAGGCA | 1363 | UGCCUACUCUUGAUAAAGG | 1364 |
| 6943 | CUUUAUCAAGAGUAGGCAA | 1365 | UUGCCUACUCUUGAUAAAG | 1366 |
| 6974 | UUCAUAUACAGAUAGACUA | 1367 | UAGUCUAUCUGUAUAUGAA | 1368 |
| 6985 | AUAGACUAUAAAGUCAUGU | 1369 | ACAUGACUUUAUAGUCUAU | 1370 |
| 6986 | UAGACUAUAAAGUCAUGUA | 1371 | UACAUGACUUUAUAGUCUA | 1372 |
| 7040 | CAAGUUGCUUGUAAAGCUA | 1373 | UAGCUUUACAAGCAACUUG | 1374 |
| 7041 | AAGUUGCUUGUAAAGCUAA | 1375 | UUAGCUUUACAAGCAACUU | 1376 |
| 7045 | UGCUUGUAAAGCUAAUCUA | 1377 | UAGAUUAGCUUUACAAGCA | 1378 |
| 7046 | GCUUGUAAAGCUAAUCUAA | 1379 | UUAGAUUAGCUUUACAAGC | 1380 |

TABLE 6B

Human EGNL2 Single Strands and Duplex Sequences

| Start | Sense Sequence (5' to 3') | SEQ ID NO. | Antisense Sequence (5' to 3') | SEQ ID NO. |
|---|---|---|---|---|
| 64 | CCACCCUGAAGGGUCCCUU | 1381 | AAGGGACCCUUCAGGGUGG | 1382 |
| 76 | GUCCCUUCCCAAGCCCUUA | 1383 | UAAGGGCUUGGGAAGGGAC | 1384 |
| 80 | CUUCCCAAGCCCUUAGGGA | 1385 | UCCCUAAGGGCUUGGGAAG | 1386 |
| 85 | CAAGCCCUUAGGGACCGCA | 1387 | UGCGGUCCCUAAGGGCUUG | 1388 |
| 93 | UAGGGACCGCAGAGGACUU | 1389 | AAGUCCUCUGCGGUCCCUA | 1390 |
| 98 | ACCGCAGAGGACUUGGGGA | 1391 | UCCCCAAGUCCUCUGCGGU | 1392 |
| 108 | ACUUGGGGACCAGCAAGCA | 1393 | UGCUUGCUGGUCCCCAAGU | 1394 |
| 109 | CUUGGGGACCAGCAAGCAA | 1395 | UUGCUUGCUGGUCCCCAAG | 1396 |
| 115 | GACCAGCAAGCAACCCCCA | 1397 | UGGGGGUUGCUUGCUGGUC | 1398 |
| 125 | CAACCCCAGGGCACGAGA | 1399 | UCUCGUGCCCUGGGGGUUG | 1400 |
| 126 | AACCCCCAGGGCACGAGAA | 1401 | UUCUCGUGCCCUGGGGGUU | 1402 |
| 128 | CCCCCAGGGCACGAGAAGA | 1403 | UCUUCUCGUGCCCUGGGGG | 1404 |
| 137 | CACGAGAAGAGCUCUUGCU | 1405 | AGCAAGAGCUCUUCUCGUG | 1406 |
| 139 | CGAGAAGAGCUCUUGCUGU | 1407 | ACAGCAAGAGCUCUUCUCG | 1408 |
| 141 | AGAAGAGCUCUUGCUGUCU | 1409 | AGACAGCAAGAGCUCUUCU | 1410 |

TABLE 6B-continued

Human EGNL2 Single Strands and Duplex Sequences

| Start | Sense Sequence (5' to 3') | SEQ ID NO. | Antisense Sequence (5' to 3') | SEQ ID NO. |
|---|---|---|---|---|
| 195 | GCCCCCAGCUGCAUCAAGU | 1411 | ACUUGAUGCAGCUGGGGGC | 1412 |
| 244 | CACCAUGGGCCCGGGCGGU | 1413 | ACCGCCCGGGCCCAUGGUG | 1414 |
| 253 | CCCGGGCGGUGCCCUCCAU | 1415 | AUGGAGGGCACCGCCCGGG | 1416 |
| 266 | CUCCAUGCCCGGGGAUGA | 1417 | UCAUCCCCGGGCAUGGAG | 1418 |
| 269 | CAUGCCCGGGGAUGAAGA | 1419 | UCUUCAUCCCCGGGCAUG | 1420 |
| 271 | UGCCCGGGGAUGAAGACA | 1421 | UGUCUUCAUCCCCGGGCA | 1422 |
| 273 | CCCGGGGAUGAAGACACU | 1423 | AGUGUCUUCAUCCCCGGG | 1424 |
| 276 | GGGGGAUGAAGACACUGCU | 1425 | AGCAGUGUCUUCAUCCCCC | 1426 |
| 310 | UGCCAGCCGCAGCCCCUAA | 1427 | UUAGGGGCUGCGGCUGGCA | 1428 |
| 314 | AGCCGCAGCCCCUAAGUCA | 1429 | UGACUUAGGGGCUGCGGCU | 1430 |
| 318 | GCAGCCCCUAAGUCAGGCU | 1431 | AGCCUGACUUAGGGGCUGC | 1432 |
| 320 | AGCCCCUAAGUCAGGCUCU | 1433 | AGAGCCUGACUUAGGGGCU | 1434 |
| 324 | CCUAAGUCAGGCUCUCCCU | 1435 | AGGGAGAGCCUGACUUAGG | 1436 |
| 328 | AGUCAGGCUCUCCCUCAGU | 1437 | ACUGAGGGAGAGCCUGACU | 1438 |
| 329 | GUCAGGCUCUCCCUCAGUU | 1439 | AACUGAGGGAGAGCCUGAC | 1440 |
| 340 | CCUCAGUUACCAGGGUCUU | 1441 | AAGACCCUGGUAACUGAGG | 1442 |
| 343 | CAGUUACCAGGGUCUUCGU | 1443 | ACGAAGACCCUGGUAACUG | 1444 |
| 345 | GUUACCAGGGUCUUCGUCA | 1445 | UGACGAAGACCCUGGUAAC | 1446 |
| 347 | UACCAGGGUCUUCGUCAGA | 1447 | UCUGACGAAGACCCUGGUA | 1448 |
| 398 | UGGGAGUGGAGAGUUACCU | 1449 | AGGUAACUCUCCACUCCCA | 1450 |
| 441 | CCACUGUCCAGGAGUGCCU | 1451 | AGGCACUCCUGGACAGUGG | 1452 |
| 456 | GCCUAGUGAGGCCUCGGCA | 1453 | UGCCGAGGCCUCACUAGGC | 1454 |
| 516 | CAGCCCUCUUCGGGACGGU | 1455 | ACCGUCCCGAAGAGGGCUG | 1456 |
| 518 | GCCCUCUUCGGGACGGUUU | 1457 | AAACCGUCCCGAAGAGGGC | 1458 |
| 519 | CCCUCUUCGGGACGGUUUU | 1459 | AAAACCGUCCCGAAGAGGG | 1460 |
| 527 | GGGACGGUUUUGGCGGGCA | 1461 | UGCCCGCCAAAACCGUCCC | 1462 |
| 531 | CGGUUUUGGCGGGCAGGAU | 1463 | AUCCUGCCCGCCAAAACCG | 1464 |
| 534 | UUUUGGCGGGCAGGAUGGU | 1465 | ACCAUCCUGCCCGCCAAAA | 1466 |
| 561 | GCGGCCGCUGCAGAGUGAA | 1467 | UUCACUCUGCAGCGGCCGC | 1468 |
| 567 | GCUGCAGAGUGAAGGCGCU | 1469 | AGCGCCUUCACUCUGCAGC | 1470 |
| 583 | GCUGCAGCGCUGGUCACCA | 1471 | UGGUGACCAGCGCUGCAGC | 1472 |
| 593 | UGGUCACCAAGGGGUGCCA | 1473 | UGGCACCCCUUGGUGACCA | 1474 |
| 598 | ACCAAGGGGUGCCAGCGAU | 1475 | AUCGCUGGCACCCCUUGGU | 1476 |
| 599 | CCAAGGGGUGCCAGCGAUU | 1477 | AAUCGCUGGCACCCCUUGG | 1478 |
| 603 | GGGGUGCCAGCGAUUGGCA | 1479 | UGCCAAUCGCUGGCACCCC | 1480 |
| 615 | AUUGGCAGCCCAGGGCGCA | 1481 | UGCGCCCUGGGCUGCCAAU | 1482 |
| 637 | CCUGAGGCCCCCAAACGGA | 1483 | UCCGUUUGGGGGCCUCAGG | 1484 |

TABLE 6B-continued

Human EGNL2 Single Strands and Duplex Sequences

| Start | Sense Sequence (5' to 3') | SEQ ID NO. | Antisense Sequence (5' to 3') | SEQ ID NO. |
|---|---|---|---|---|
| 638 | CUGAGGCCCCCAAACGGAA | 1485 | UUCCGUUUGGGGGCCUCAG | 1486 |
| 639 | UGAGGCCCCCAAACGGAAA | 1487 | UUUCCGUUUGGGGGCCUCA | 1488 |
| 640 | GAGGCCCCCAAACGGAAAU | 1489 | AUUUCCGUUUGGGGGCCUC | 1490 |
| 650 | AACGGAAAUGGGCCGAGGA | 1491 | UCCUCGGCCCAUUUCCGUU | 1492 |
| 651 | ACGGAAAUGGGCCGAGGAU | 1493 | AUCCUCGGCCCAUUUCCGU | 1494 |
| 654 | GAAAUGGGCCGAGGAUGGU | 1495 | ACCAUCCUCGGCCCAUUUC | 1496 |
| 685 | UCACCCAGCAAACGGCCCU | 1497 | AGGGCCGUUUGCUGGGUGA | 1498 |
| 704 | GGGCCAGGCAAGAGAACCA | 1499 | UGGUUCUCUUGCCUGGCCC | 1500 |
| 803 | CGCUGCCCUCUGCGCCCGA | 1501 | UCGGGCGCAGAGGGCAGCG | 1502 |
| 824 | GCCUGGCCCUGGACUAUAU | 1503 | AUAUAGUCCAGGGCCAGGC | 1504 |
| 827 | UGGCCCUGGACUAUAUCGU | 1505 | ACGAUAUAGUCCAGGGCCA | 1506 |
| 835 | GACUAUAUCGUGCCCUGCA | 1507 | UGCAGGGCACGAUAUAGUC | 1508 |
| 836 | ACUAUAUCGUGCCCUGCAU | 1509 | AUGCAGGGCACGAUAUAGU | 1510 |
| 842 | UCGUGCCCUGCAUGCGGUA | 1511 | UACCGCAUGCAGGGCACGA | 1512 |
| 844 | GUGCCCUGCAUGCGGUACU | 1513 | AGUACCGCAUGCAGGGCAC | 1514 |
| 845 | UGCCCUGCAUGCGGUACUA | 1515 | UAGUACCGCAUGCAGGGCA | 1516 |
| 851 | GCAUGCGGUACUACGGCAU | 1517 | AUGCCGUAGUACCGCAUGC | 1518 |
| 853 | AUGCGGUACUACGGCAUCU | 1519 | AGAUGCCGUAGUACCGCAU | 1520 |
| 857 | GGUACUACGGCAUCUGCGU | 1521 | ACGCAGAUGCCGUAGUACC | 1522 |
| 859 | UACUACGGCAUCUGCGUCA | 1523 | UGACGCAGAUGCCGUAGUA | 1524 |
| 863 | ACGGCAUCUGCGUCAAGGA | 1525 | UCCUUGACGCAGAUGCCGU | 1526 |
| 868 | AUCUGCGUCAAGGACAGCU | 1527 | AGCUGUCCUUGACGCAGAU | 1528 |
| 896 | CAGCACUGGGCGGUCGCGU | 1529 | ACGCGACCGCCCAGUGCUG | 1530 |
| 899 | CACUGGGCGGUCGCGUGCU | 1531 | AGCACGCGACCGCCCAGUG | 1532 |
| 927 | GGAGGCCCUCAAACGGGU | 1533 | ACCCCGUUUGAGGGCCUCC | 1534 |
| 935 | UCAAACGGGUGGGCGCCU | 1535 | AGGCGCCCACCCCGUUUGA | 1536 |
| 939 | ACGGGGUGGGCGCCUGCGA | 1537 | UCGCAGGCGCCCACCCCGU | 1538 |
| 947 | GGCGCCUGCGAGACGGGCA | 1539 | UGCCCGUCUCGCAGGCGCC | 1540 |
| 967 | CUAGUGAGCCAGAGGGCGA | 1541 | UCGCCCUCUGGCUCACUAG | 1542 |
| 968 | UAGUGAGCCAGAGGGCGAU | 1543 | AUCGCCCUCUGGCUCACUA | 1544 |
| 982 | GCGAUCCCGCCGCGCAGCA | 1545 | UGCUGCGCGGCGGGAUCGC | 1546 |
| 983 | CGAUCCCGCCGCGCAGCAU | 1547 | AUGCUGCGCGGCGGGAUCG | 1548 |
| 987 | CCCGCCGCGCAGCAUCCGU | 1549 | ACGGAUGCUGCGCGGCGGG | 1550 |
| 992 | CGCGCAGCAUCCGUGGGGA | 1551 | UCCCCACGGAUGCUGCGCG | 1552 |
| 999 | CAUCCGUGGGGACCAGAUU | 1553 | AAUCUGGUCCCCACGGAUG | 1554 |
| 1011 | CCAGAUUGCUGGGUGGAA | 1555 | UUCCACCCAGCAAUCUGG | 1556 |
| 1019 | CCUGGGUGGAAGGCCAUGA | 1557 | UCAUGGCCUUCCACCCAGG | 1558 |

TABLE 6B-continued

Human EGNL2 Single Strands and Duplex Sequences

| Start | Sense Sequence (5' to 3') | SEQ ID NO. | Antisense Sequence (5' to 3') | SEQ ID NO. |
|---|---|---|---|---|
| 1020 | CUGGGUGGAAGGCCAUGAA | 1559 | UUCAUGGCCUUCCACCCAG | 1560 |
| 1032 | CCAUGAACCAGGCUGUCGA | 1561 | UCGACAGCCUGGUUCAUGG | 1562 |
| 1033 | CAUGAACCAGGCUGUCGAA | 1563 | UUCGACAGCCUGGUUCAUG | 1564 |
| 1036 | GAACCAGGCUGUCGAAGCA | 1565 | UGCUUCGACAGCCUGGUUC | 1566 |
| 1041 | AGGCUGUCGAAGCAUUGGU | 1567 | ACCAAUGCUUCGACAGCCU | 1568 |
| 1046 | GUCGAAGCAUUGGUGCCCU | 1569 | AGGGCACCAAUGCUUCGAC | 1570 |
| 1048 | CGAAGCAUUGGUGCCCUCA | 1571 | UGAGGGCACCAAUGCUUCG | 1572 |
| 1049 | GAAGCAUUGGUGCCCUCAU | 1573 | AUGAGGGCACCAAUGCUUC | 1574 |
| 1058 | GUGCCCUCAUGGCCCAUGU | 1575 | ACAUGGGCCAUGAGGGCAC | 1576 |
| 1070 | CCCAUGUGGACGCCGUCAU | 1577 | AUGACGGCGUCCACAUGGG | 1578 |
| 1076 | UGGACGCCGUCAUCCGCCA | 1579 | UGGCGGAUGACGGCGUCCA | 1580 |
| 1078 | GACGCCGUCAUCCGCCACU | 1581 | AGUGGCGGAUGACGGCGUC | 1582 |
| 1100 | CAGGGCGGCUGGGCAGCUA | 1583 | UAGCUGCCCAGCCGCCCUG | 1584 |
| 1103 | GGCGGCUGGGCAGCUAUGU | 1585 | ACAUAGCUGCCCAGCCGCC | 1586 |
| 1106 | GGCUGGGCAGCUAUGUCAU | 1587 | AUGACAUAGCUGCCCAGCC | 1588 |
| 1117 | UAUGUCAUCAACGGGCGCA | 1589 | UGCGCCCGUUGAUGACAUA | 1590 |
| 1120 | GUCAUCAACGGGCGCACCA | 1591 | UGGUGCGCCCGUUGAUGAC | 1592 |
| 1121 | UCAUCAACGGGCGCACCAA | 1593 | UUGGUGCGCCCGUUGAUGA | 1594 |
| 1126 | AACGGGCGCACCAAGGCCA | 1595 | UGGCCUUGGUGCGCCCGUU | 1596 |
| 1137 | CAAGGCCAUGGUGGCGUGU | 1597 | ACACGCCACCAUGGCCUUG | 1598 |
| 1143 | CAUGGUGGCGUGUUACCCA | 1599 | UGGGUAACACGCCACCAUG | 1600 |
| 1148 | UGGCGUGUUACCCAGGCAA | 1601 | UUGCCUGGGUAACACGCCA | 1602 |
| 1154 | GUUACCCAGGCAACGGGCU | 1603 | AGCCCGUUGCCUGGGUAAC | 1604 |
| 1159 | CCAGGCAACGGGCUCGGGU | 1605 | ACCCGAGCCCGUUGCCUGG | 1606 |
| 1160 | CAGGCAACGGGCUCGGGUA | 1607 | UACCCGAGCCCGUUGCCUG | 1608 |
| 1163 | GCAACGGGCUCGGGUACGU | 1609 | ACGUACCCGAGCCCGUUGC | 1610 |
| 1164 | CAACGGGCUCGGGUACGUA | 1611 | UACGUACCCGAGCCCGUUG | 1612 |
| 1165 | AACGGGCUCGGGUACGUAA | 1613 | UUACGUACCCGAGCCCGUU | 1614 |
| 1169 | GGCUCGGGUACGUAAGGCA | 1615 | UGCCUUACGUACCCGAGCC | 1616 |
| 1172 | UCGGGUACGUAAGGCACGU | 1617 | ACGUGCCUUACGUACCCGA | 1618 |
| 1173 | CGGGUACGUAAGGCACGUU | 1619 | AACGUGCCUUACGUACCCG | 1620 |
| 1175 | GGUACGUAAGGCACGUUGA | 1621 | UCAACGUGCCUUACGUACC | 1622 |
| 1177 | UACGUAAGGCACGUUGACA | 1623 | UGUCAACGUGCCUUACGUA | 1624 |
| 1178 | ACGUAAGGCACGUUGACAA | 1625 | UUGUCAACGUGCCUUACGU | 1626 |
| 1179 | CGUAAGGCACGUUGACAAU | 1627 | AUUGUCAACGUGCCUUACG | 1628 |
| 1190 | UUGCAAUCCCCACGGCGA | 1629 | UCGCCGUGGGGAUUGCAA | 1630 |
| 1191 | UGACAAUCCCCACGGCGAU | 1631 | AUCGCCGUGGGGAUUGUCA | 1632 |

TABLE 6B-continued

Human EGNL2 Single Strands and Duplex Sequences

| Start | Sense Sequence (5' to 3') | SEQ ID NO. | Antisense Sequence (5' to 3') | SEQ ID NO. |
|---|---|---|---|---|
| 1201 | CACGGCGAUGGGCGCUGCA | 1633 | UGCAGCGCCCAUCGCCGUG | 1634 |
| 1210 | GGGCGCUGCAUCACCUGUA | 1635 | UACAGGUGAUGCAGCGCCC | 1636 |
| 1211 | GGCGCUGCAUCACCUGUAU | 1637 | AUACAGGUGAUGCAGCGCC | 1638 |
| 1213 | CGCUGCAUCACCUGUAUCU | 1639 | AGAUACAGGUGAUGCAGCG | 1640 |
| 1216 | UGCAUCACCUGUAUCUAUU | 1641 | AAUAGAUACAGGUGAUGCA | 1642 |
| 1217 | GCAUCACCUGUAUCUAUUA | 1643 | UAAUAGAUACAGGUGAUGC | 1644 |
| 1220 | UCACCUGUAUCUAUUACCU | 1645 | AGGUAAUAGAUACAGGUGA | 1646 |
| 1222 | ACCUGUAUCUAUUACCUGA | 1647 | UCAGGUAAUAGAUACAGGU | 1648 |
| 1223 | CCUGUAUCUAUUACCUGAA | 1649 | UUCAGGUAAUAGAUACAGG | 1650 |
| 1226 | GUAUCUAUUACCUGAAUCA | 1651 | UGAUUCAGGUAAUAGAUAC | 1652 |
| 1228 | AUCUAUUACCUGAAUCAGA | 1653 | UCUGAUUCAGGUAAUAGAU | 1654 |
| 1231 | UAUUACCUGAAUCAGAACU | 1655 | AGUUCUGAUUCAGGUAAUA | 1656 |
| 1238 | UGAAUCAGAACUGGGACGU | 1657 | ACGUCCCAGUUCUGAUUCA | 1658 |
| 1239 | GAAUCAGAACUGGGACGUU | 1659 | AACGUCCCAGUUCUGAUUC | 1660 |
| 1240 | AAUCAGAACUGGGACGUUA | 1661 | UAACGUCCCAGUUCUGAUU | 1662 |
| 1241 | AUCAGAACUGGGACGUUAA | 1663 | UUAACGUCCCAGUUCUGAU | 1664 |
| 1244 | AGAACUGGGACGUUAAGGU | 1665 | ACCUUAACGUCCCAGUUCU | 1666 |
| 1247 | ACUGGGACGUUAAGGUGCA | 1667 | UGCACCUUAACGUCCCAGU | 1668 |
| 1248 | CUGGGACGUUAAGGUGCAU | 1669 | AUGCACCUUAACGUCCCAG | 1670 |
| 1256 | UUAAGGUGCAUGGCGGCCU | 1671 | AGGCCGCCAUGCACCUUAA | 1672 |
| 1259 | AGGUGCAUGGCGGCCUGCU | 1673 | AGCAGGCCGCCAUGCACCU | 1674 |
| 1294 | GGCCGGCCCGUGGUAGCCA | 1675 | UGGCUACCACGGGCCGGCC | 1676 |
| 1295 | GCCGGCCCGUGGUAGCCAA | 1677 | UUGGCUACCACGGGCCGGC | 1678 |
| 1297 | CGGCCCGUGGUAGCCAACA | 1679 | UGUUGGCUACCACGGGCCG | 1680 |
| 1298 | GGCCCGUGGUAGCCAACAU | 1681 | AUGUUGGCUACCACGGGCC | 1682 |
| 1309 | GCCAACAUCGAGCCACUCU | 1683 | AGAGUGGCUCGAUGUUGGC | 1684 |
| 1310 | CCAACAUCGAGCCACUCUU | 1685 | AAGAGUGGCUCGAUGUUGG | 1686 |
| 1311 | CAACAUCGAGCCACUCUUU | 1687 | AAAGAGUGGCUCGAUGUUG | 1688 |
| 1313 | ACAUCGAGCCACUCUUUGA | 1689 | UCAAAGAGUGGCUCGAUGU | 1690 |
| 1318 | GAGCCACUCUUUGACCGGU | 1691 | ACCGGUCAAAGAGUGGCUC | 1692 |
| 1319 | AGCCACUCUUUGACCGGUU | 1693 | AACCGGUCAAAGAGUGGCU | 1694 |
| 1322 | CACUCUUUGACCGGUUGCU | 1695 | AGCAACCGGUCAAAGAGUG | 1696 |
| 1324 | CUCUUUGACCGGUUGCUCA | 1697 | UGAGCAACCGGUCAAAGAG | 1698 |
| 1325 | UCUUUGACCGGUUGCUCAU | 1699 | AUGAGCAACCGGUCAAAGA | 1700 |
| 1326 | CUUUGACCGGUUGCUCAUU | 1701 | AAUGAGCAACCGGUCAAAG | 1702 |
| 1327 | UUUGACCGGUUGCUCAUUU | 1703 | AAAUGAGCAACCGGUCAAA | 1704 |
| 1330 | GACCGGUUGCUCAUUUUCU | 1705 | AGAAAAUGAGCAACCGGUC | 1706 |

TABLE 6B-continued

Human EGNL2 Single Strands and Duplex Sequences

| Start | Sense Sequence (5' to 3') | SEQ ID NO. | Antisense Sequence (5' to 3') | SEQ ID NO. |
|---|---|---|---|---|
| 1346 | UCUGGUCUGACCGGCGGAA | 1707 | UUCCGCCGGUCAGACCAGA | 1708 |
| 1352 | CUGACCGGCGGAACCCCCA | 1709 | UGGGGGUUCCGCCGGUCAG | 1710 |
| 1355 | ACCGGCGGAACCCCCACGA | 1711 | UCGUGGGGGUUCCGCCGGU | 1712 |
| 1358 | GGCGGAACCCCCACGAGGU | 1713 | ACCUCGUGGGGGUUCCGCC | 1714 |
| 1361 | GGAACCCCCACGAGGUGAA | 1715 | UUCACCUCGUGGGGGUUCC | 1716 |
| 1370 | ACGAGGUGAAGCCAGCCUA | 1717 | UAGGCUGGCUUCACCUCGU | 1718 |
| 1375 | GUGAAGCCAGCCUAUGCCA | 1719 | UGGCAUAGGCUGGCUUCAC | 1720 |
| 1381 | CCAGCCUAUGCCACCAGGU | 1721 | ACCUGGUGGCAUAGGCUGG | 1722 |
| 1387 | UAUGCCACCAGGUACGCCA | 1723 | UGGCGUACCUGGUGGCAUA | 1724 |
| 1388 | AUGCCACCAGGUACGCCAU | 1725 | AUGGCGUACCUGGUGGCAU | 1726 |
| 1394 | CCAGGUACGCCAUCACUGU | 1727 | ACAGUGAUGGCGUACCUGG | 1728 |
| 1396 | AGGUACGCCAUCACUGUCU | 1729 | AGACAGUGAUGGCGUACCU | 1730 |
| 1401 | CGCCAUCACUGUCUGGUAU | 1731 | AUACCAGACAGUGAUGGCG | 1732 |
| 1403 | CCAUCACUGUCUGGUAUUU | 1733 | AAAUACCAGACAGUGAUGG | 1734 |
| 1438 | GCAGCAGCCAAAGACAAGU | 1735 | ACUUGUCUUUGGCUGCUGC | 1736 |
| 1440 | AGCAGCCAAAGACAAGUAU | 1737 | AUACUUGUCUUUGGCUGCU | 1738 |
| 1442 | CAGCCAAAGACAAGUAUCA | 1739 | UGAUACUUGUCUUUGGCUG | 1740 |
| 1446 | CAAAGACAAGUAUCAGCUA | 1741 | UAGCUGAUACUUGUCUUUG | 1742 |
| 1449 | AGACAAGUAUCAGCUAGCA | 1743 | UGCUAGCUGAUACUUGUCU | 1744 |
| 1450 | GACAAGUAUCAGCUAGCAU | 1745 | AUGCUAGCUGAUACUUGUC | 1746 |
| 1452 | CAAGUAUCAGCUAGCAUCA | 1747 | UGAUGCUAGCUGAUACUUG | 1748 |
| 1455 | GUAUCAGCUAGCAUCAGGA | 1749 | UCCUGAUGCUAGCUGAUAC | 1750 |
| 1457 | AUCAGCUAGCAUCAGGACA | 1751 | UGUCCUGAUGCUAGCUGAU | 1752 |
| 1459 | CAGCUAGCAUCAGGACAGA | 1753 | UCUGUCCUGAUGCUAGCUG | 1754 |
| 1461 | GCUAGCAUCAGGACAGAAA | 1755 | UUUCUGUCCUGAUGCUAGC | 1756 |
| 1476 | GAAAGGUGUCCAAGUACCU | 1757 | AGGUACUUGGACACCUUUC | 1758 |
| 1482 | UGUCCAAGUACCUGUAUCA | 1759 | UGAUACAGGUACUUGGACA | 1760 |
| 1504 | CCGCCUACGCCCACCUAGU | 1761 | ACUAGGUGGGCGUAGGCGG | 1762 |
| 1509 | UACGCCCACCUAGUGGCCA | 1763 | UGGCCACUAGGUGGGCGUA | 1764 |
| 1517 | CCUAGUGGCCAGUCCCAGA | 1765 | UCUGGGACUGGCCACUAGG | 1766 |
| 1538 | CGCAUGGCAGACAGCUUAA | 1767 | UUAAGCUGUCUGCCAUGCG | 1768 |
| 1539 | GCAUGGCAGACAGCUUAAA | 1769 | UUUAAGCUGUCUGCCAUGC | 1770 |
| 1542 | UGGCAGACAGCUUAAAUGA | 1771 | UCAUUUAAGCUGUCUGCCA | 1772 |
| 1544 | GCAGACAGCUUAAAUGACU | 1773 | AGUCAUUUAAGCUGUCUGC | 1774 |
| 1674 | AGGAGGAGAAGAGACCUUU | 1775 | AAAGGUCUCUUCUCCUCCU | 1776 |
| 1684 | GAGACCUUUGCUGCCCCAU | 1777 | AUGGGGCAGCAAAGGUCUC | 1778 |
| 1702 | UCAUGGGGCUGGGGUUGU | 1779 | ACAACCCCAGCCCCAUGA | 1780 |

TABLE 6B-continued

Human EGNL2 Single Strands and Duplex Sequences

| Start | Sense Sequence (5' to 3') | SEQ ID NO. | Antisense Sequence (5' to 3') | SEQ ID NO. |
|---|---|---|---|---|
| 1741 | GUGGAGGCCACCGUUACCA | 1781 | UGGUAACGGUGGCCUCCAC | 1782 |
| 1742 | UGGAGGCCACCGUUACCAA | 1783 | UUGGUAACGGUGGCCUCCA | 1784 |
| 1744 | GAGGCCACCGUUACCAACU | 1785 | AGUUGGUAACGGUGGCCUC | 1786 |
| 1746 | GGCCACCGUUACCAACUGA | 1787 | UCAGUUGGUAACGGUGGCC | 1788 |
| 1774 | CCUGGGUCCUACCCUGUCU | 1789 | AGACAGGGUAGGACCCAGG | 1790 |
| 1779 | GUCCUACCCUGUCUGGUCA | 1791 | UGACCAGACAGGGUAGGAC | 1792 |
| 1782 | CUACCCUGUCUGGUCAUGA | 1793 | UCAUGACCAGACAGGGUAG | 1794 |
| 1787 | CUGUCUGGUCAUGACCCCA | 1795 | UGGGGUCAUGACCAGACAG | 1796 |
| 1788 | UGUCUGGUCAUGACCCCAU | 1797 | AUGGGGUCAUGACCAGACA | 1798 |
| 1789 | GUCUGGUCAUGACCCCAUU | 1799 | AAUGGGGUCAUGACCAGAC | 1800 |
| 1798 | UGACCCCAUUAGGUAUGGA | 1801 | UCCAUACCUAAUGGGGUCA | 1802 |
| 1800 | ACCCCAUUAGGUAUGGAGA | 1803 | UCUCCAUACCUAAUGGGGU | 1804 |
| 1807 | UAGGUAUGGAGAGCUGGGA | 1805 | UCCCAGCUCUCCAUACCUA | 1806 |
| 1820 | CUGGGAGGAGGCAUUGUCA | 1807 | UGACAAUGCCUCCUCCCAG | 1808 |
| 1823 | GGAGGAGGCAUUGUCACUU | 1809 | AAGUGACAAUGCCUCCUCC | 1810 |
| 1827 | GAGGCAUUGUCACUUCCCA | 1811 | UGGGAAGUGACAAUGCCUC | 1812 |
| 1830 | GCAUUGUCACUUCCCACCA | 1813 | UGGUGGGAAGUGACAAUGC | 1814 |
| 1856 | GGACUUGGGGUUGAGGUGA | 1815 | UCACCUCAACCCCAAGUCC | 1816 |
| 1858 | ACUUGGGGUUGAGGUGAGU | 1817 | ACUCACCUCAACCCCAAGU | 1818 |
| 1861 | UGGGGUUGAGGUGAGUCAU | 1819 | AUGACUCACCUCAACCCCA | 1820 |
| 1866 | UUGAGGUGAGUCAUGGCCU | 1821 | AGGCCAUGACUCACCUCAA | 1822 |
| 1868 | GAGGUGAGUCAUGGCCUCU | 1823 | AGAGGCCAUGACUCACCUC | 1824 |
| 1872 | UGAGUCAUGGCCUCUUGCU | 1825 | AGCAAGAGGCCAUGACUCA | 1826 |
| 1876 | UCAUGGCCUCUUGCUGGCA | 1827 | UGCCAGCAAGAGGCCAUGA | 1828 |
| 1878 | AUGGCCUCUUGCUGGCAAU | 1829 | AUUGCCAGCAAGAGGCCAU | 1830 |
| 1883 | CUCUUGCUGGCAAUGGGU | 1831 | ACCCCAUUGCCAGCAAGAG | 1832 |
| 1893 | CAAUGGGGUGGGAGGAGUA | 1833 | UACUCCUCCCACCCCAUUG | 1834 |
| 1902 | GGGAGGAGUACCCCCAAGU | 1835 | ACUUGGGGGUACUCCUCCC | 1836 |
| 1905 | AGGAGUACCCCCAAGUCCU | 1837 | AGGACUUGGGGGUACUCCU | 1838 |
| 1931 | CUCCAGCCUGGAAUGUGAA | 1839 | UUCACAUUCCAGGCUGGAG | 1840 |
| 1933 | CCAGCCUGGAAUGUGAAGU | 1841 | ACUUCACAUUCCAGGCUGG | 1842 |
| 1942 | AAUGUGAAGUGACUCCCCA | 1843 | UGGGGAGUCACUUCACAUU | 1844 |
| 1964 | CCUUUGGCCAUGGCAGGCA | 1845 | UGCCUGCCAUGGCCAAAGG | 1846 |
| 1973 | AUGGCAGGCACCUUUUGGA | 1847 | UCCAAAAGGUGCCUGCCAU | 1848 |
| 1980 | GCACCUUUUGGACUGGGCU | 1849 | AGCCCAGUCCAAAAGGUGC | 1850 |
| 2001 | CACUGCUUGGGCAGAGUAA | 1851 | UUACUCUGCCCAAGCAGUG | 1852 |
| 2002 | ACUGCUUGGGCAGAGUAAA | 1853 | UUUACUCUGCCCAAGCAGU | 1854 |

TABLE 6B-continued

Human EGNL2 Single Strands and Duplex Sequences

| Start | Sense Sequence (5' to 3') | SEQ ID NO. | Antisense Sequence (5' to 3') | SEQ ID NO. |
|---|---|---|---|---|
| 2003 | CUGCUUGGGCAGAGUAAAA | 1855 | UUUUACUCUGCCCAAGCAG | 1856 |
| 2006 | CUUGGGCAGAGUAAAAGGU | 1857 | ACCUUUUACUCUGCCCAAG | 1858 |
| 2010 | GGCAGAGUAAAAGGUGCCA | 1859 | UGGCACCUUUUACUCUGCC | 1860 |
| 2077 | CCUCAGAGCUGCAAAAAAA | 1861 | UUUUUUUGCAGCUCUGAGG | 1862 |

TABLE 6C

Human EGNL3 Single Strands and Duplex Sequences

| Start | Sense Sequence (5' to 3') | SEQ ID NO. | Antisense Sequence (5' to 3') | SEQ ID NO. |
|---|---|---|---|---|
| 6 | UGGCCGCAGUCGCGGCAGU | 1863 | ACUGCCGCGACUGCGGCCA | 1864 |
| 35 | CAUCCCCAAAAGGCGCCCU | 1865 | AGGGCGCCUUUUGGGGAUG | 1866 |
| 41 | CAAAAGGCGCCCUCCGACU | 1867 | AGUCGGAGGGCGCCUUUUG | 1868 |
| 53 | UCCGACUCCUUGCGCCGCA | 1869 | UGCGGCGCAAGGAGUCGGA | 1870 |
| 58 | CUCCUUGCGCCGCACUGCU | 1871 | AGCAGUGCGGCGCAAGGAG | 1872 |
| 75 | CUCGCCGGGCCAGUCCGGA | 1873 | UCCGGACUGGCCCGGCGAG | 1874 |
| 76 | UCGCCGGGCCAGUCCGGAA | 1875 | UUCCGGACUGGCCCGGCGA | 1876 |
| 77 | CGCCGGGCCAGUCCGGAAA | 1877 | UUUCCGGACUGGCCCGGCG | 1878 |
| 85 | CAGUCCGGAAACGGGUCGU | 1879 | ACGACCCGUUUCCGGACUG | 1880 |
| 88 | UCCGGAAACGGGUCGUGGA | 1881 | UCCACGACCCGUUUCCGGA | 1882 |
| 99 | GUCGUGGAGCUCCGCACCA | 1883 | UGGUGCGGAGCUCCACGAC | 1884 |
| 101 | CGUGGAGCUCCGCACCACU | 1885 | AGUGGUGCGGAGCUCCACG | 1886 |
| 107 | GCUCCGCACCACUCCCGCU | 1887 | AGCGGGAGUGGUGCGGAGC | 1888 |
| 111 | CGCACCACUCCCGCUGGUU | 1889 | AACCAGCGGGAGUGGUGCG | 1890 |
| 123 | GCUGGUUCCCGAAGGCAGA | 1891 | UCUGCCUUCGGGAACCAGC | 1892 |
| 129 | UCCCGAAGGCAGAUCCCUU | 1893 | AAGGGAUCUGCCUUCGGGA | 1894 |
| 138 | CAGAUCCCUUCUCCCGAGA | 1895 | UCUCGGGAGAAGGGAUCUG | 1896 |
| 140 | GAUCCCUUCUCCCGAGAGU | 1897 | ACUCUCGGGAGAAGGGAUC | 1898 |
| 141 | AUCCCUUCUCCCGAGAGUU | 1899 | AACUCUCGGGAGAAGGGAU | 1900 |
| 145 | CUUCUCCCGAGAGUUGCGA | 1901 | UCGCAACUCUCGGGAGAAG | 1902 |
| 147 | UCUCCCGAGAGUUGCGAGA | 1903 | UCUCGCAACUCUCGGGAGA | 1904 |
| 148 | CUCCCGAGAGUUGCGAGAA | 1905 | UUCUCGCAACUCUCGGGAG | 1906 |
| 149 | UCCCGAGAGUUGCGAGAAA | 1907 | UUUCUCGCAACUCUCGGGA | 1908 |
| 151 | CCGAGAGUUGCGAGAAACU | 1909 | AGUUUCUCGCAACUCUCGG | 1910 |
| 152 | CGAGAGUUGCGAGAAACUU | 1911 | AAGUUUCUCGCAACUCUCG | 1912 |
| 153 | GAGAGUUGCGAGAAACUUU | 1913 | AAAGUUUCUCGCAACUCUC | 1914 |
| 158 | UUGCGAGAAACUUUCCCUU | 1915 | AAGGGAAAGUUUCUCGCAA | 1916 |
| 160 | GCGAGAAACUUUCCCUUGU | 1917 | ACAAGGGAAAGUUUCUCGC | 1918 |

TABLE 6C-continued

Human EGNL3 Single Strands and Duplex Sequences

| Start | Sense Sequence (5' to 3') | SEQ ID NO. | Antisense Sequence (5' to 3') | SEQ ID NO. |
|---|---|---|---|---|
| 189 | GCAGCGGCUCGGGUACCGU | 1919 | ACGGUACCCGAGCCGCUGC | 1920 |
| 206 | GUGGCAGCCGCAGGUUUCU | 1921 | AGAAACCUGCGGCUGCCAC | 1922 |
| 208 | GGCAGCCGCAGGUUUCUGA | 1923 | UCAGAAACCUGCGGCUGCC | 1924 |
| 209 | GCAGCCGCAGGUUUCUGAA | 1925 | UUCAGAAACCUGCGGCUGC | 1926 |
| 245 | CGCGCCUCGGCUUCGCGCU | 1927 | AGCGCGAAGCCGAGGCGCG | 1928 |
| 250 | CUCGGCUUCGCGCUCGUGU | 1929 | ACACGAGCGCGAAGCCGAG | 1930 |
| 251 | UCGGCUUCGCGCUCGUGUA | 1931 | UACACGAGCGCGAAGCCGA | 1932 |
| 253 | GGCUUCGCGCUCGUGUAGA | 1933 | UCUACACGAGCGCGAAGCC | 1934 |
| 254 | GCUUCGCGCUCGUGUAGAU | 1935 | AUCUACACGAGCGCGAAGC | 1936 |
| 257 | UCGCGCUCGUGUAGAUCGU | 1937 | ACGAUCUACACGAGCGCGA | 1938 |
| 258 | CGCGCUCGUGUAGAUCGUU | 1939 | AACGAUCUACACGAGCGCG | 1940 |
| 262 | CUCGUGUAGAUCGUUCCCU | 1941 | AGGGAACGAUCUACACGAG | 1942 |
| 270 | GAUCGUUCCCUCUCUGGUU | 1943 | AACCAGAGAGGGAACGAUC | 1944 |
| 273 | CGUUCCCUCUCUGGUUGCA | 1945 | UGCAACCAGAGAGGGAACG | 1946 |
| 277 | CCCUCUCUGGUUGCACGCU | 1947 | AGCGUGCAACCAGAGAGGG | 1948 |
| 282 | UCUGGUUGCACGCUGGGGA | 1949 | UCCCCAGCGUGCAACCAGA | 1950 |
| 283 | CUGGUUGCACGCUGGGGAU | 1951 | AUCCCCAGCGUGCAACCAG | 1952 |
| 295 | UGGGGAUCCCGGACCUCGA | 1953 | UCGAGGUCCGGGAUCCCCA | 1954 |
| 296 | GGGGAUCCCGGACCUCGAU | 1955 | AUCGAGGUCCGGGAUCCCC | 1956 |
| 299 | GAUCCCGGACCUCGAUUCU | 1957 | AGAAUCGAGGUCCGGGAUC | 1958 |
| 307 | ACCUCGAUUCUGCGGGCGA | 1959 | UCGCCCGCAGAAUCGAGGU | 1960 |
| 309 | CUCGAUUCUGCGGGCGAGA | 1961 | UCUCGCCCGCAGAAUCGAG | 1962 |
| 355 | ACCUGGAGAAAAUUGCCCU | 1963 | AGGGCAAUUUUCUCCAGGU | 1964 |
| 367 | UUGCCCUGGAGUACAUCGU | 1965 | ACGAUGUACUCCAGGGCAA | 1966 |
| 376 | AGUACAUCGUGCCCUGUCU | 1967 | AGACAGGGCACGAUGUACU | 1968 |
| 382 | UCGUGCCCUGUCUGCACGA | 1969 | UCGUGCAGACAGGGCACGA | 1970 |
| 390 | UGUCUGCACGAGGUGGGCU | 1971 | AGCCCACCUCGUGCAGACA | 1972 |
| 451 | GCGUCCUGGAGCGCGUCAA | 1973 | UUGACGCGCUCCAGGACGC | 1974 |
| 521 | CGCCGGCGUCUCCAAGCGA | 1975 | UCGCUUGGAGACGCCGGCG | 1976 |
| 526 | GCGUCUCCAAGCGACACCU | 1977 | AGGUGUCGCUUGGAGACGC | 1978 |
| 538 | GACACCGCGGGGCGACCA | 1979 | UGGUCGCCCCGCAGGUGUC | 1980 |
| 540 | CACCUGCGGGGCGACCAGA | 1981 | UCUGGUCGCCCCGCAGGUG | 1982 |
| 559 | UCACGUGGAUCGGGGCAA | 1983 | UUGCCCCCGAUCCACGUGA | 1984 |
| 565 | GGAUCGGGGCAACGAGGA | 1985 | UCCUCGUUGCCCCCGAUCC | 1986 |
| 619 | UCGACAGGCUGGUCCUCUA | 1987 | UAGAGGACCAGCCUGUCGA | 1988 |
| 621 | GACAGGCUGGUCCUCUACU | 1989 | AGUAGAGGACCAGCCUGUC | 1990 |
| 627 | CUGGUCCUCUACUGCGGGA | 1991 | UCCCGCAGUAGAGGACCAG | 1992 |

TABLE 6C-continued

Human EGNL3 Single Strands and Duplex Sequences

| Start | Sense Sequence (5' to 3') | SEQ ID NO. | Antisense Sequence (5' to 3') | SEQ ID NO. |
|---|---|---|---|---|
| 643 | GGAGCCGGCUGGGCAAAUA | 1993 | UAUUUGCCCAGCCGGCUCC | 1994 |
| 646 | GCCGGCUGGGCAAAUACUA | 1995 | UAGUAUUUGCCCAGCCGGC | 1996 |
| 649 | GGCUGGGCAAAUACUACGU | 1997 | ACGUAGUAUUUGCCCAGCC | 1998 |
| 651 | CUGGGCAAAUACUACGUCA | 1999 | UGACGUAGUAUUUGCCCAG | 2000 |
| 652 | UGGGCAAAUACUACGUCAA | 2001 | UUGACGUAGUAUUUGCCCA | 2002 |
| 655 | GCAAAUACUACGUCAAGGA | 2003 | UCCUUGACGUAGUAUUUGC | 2004 |
| 662 | CUACGUCAAGGAGAGGUCU | 2005 | AGACCUCUCCUUGACGUAG | 2006 |
| 663 | UACGUCAAGGAGAGGUCUA | 2007 | UAGACCUCUCCUUGACGUA | 2008 |
| 668 | CAAGGAGAGGUCUAAGGCA | 2009 | UGCCUUAGACCUCUCCUUG | 2010 |
| 673 | AGAGGUCUAAGGCAAUGGU | 2011 | ACCAUUGCCUUAGACCUCU | 2012 |
| 678 | UCUAAGGCAAUGGUGGCUU | 2013 | AAGCCACCAUUGCCUUAGA | 2014 |
| 681 | AAGGCAAUGGUGGCUUGCU | 2015 | AGCAAGCCACCAUUGCCUU | 2016 |
| 682 | AGGCAAUGGUGGCUUGCUA | 2017 | UAGCAAGCCACCAUUGCCU | 2018 |
| 683 | GGCAAUGGUGGCUUGCUAU | 2019 | AUAGCAAGCCACCAUUGCC | 2020 |
| 690 | GUGGCUUGCUAUCCGGGAA | 2021 | UUCCCGGAUAGCAAGCCAC | 2022 |
| 691 | UGGCUUGCUAUCCGGGAAA | 2023 | UUUCCCGGAUAGCAAGCCA | 2024 |
| 692 | GGCUUGCUAUCCGGGAAAU | 2025 | AUUUCCCGGAUAGCAAGCC | 2026 |
| 696 | UGCUAUCCGGGAAAUGGAA | 2027 | UUCCAUUUCCCGGAUAGCA | 2028 |
| 702 | CCGGGAAAUGGAACAGGUU | 2029 | AACCUGUUCCAUUUCCCGG | 2030 |
| 704 | GGGAAAUGGAACAGGUUAU | 2031 | AUAACCUGUUCCAUUUCCC | 2032 |
| 712 | GAACAGGUUAUGUUCGCCA | 2033 | UGGCGAACAUAACCUGUUC | 2034 |
| 715 | CAGGUUAUGUUCGCCACGU | 2035 | ACGUGGCGAACAUAACCUG | 2036 |
| 718 | GUUAUGUUCGCCACGUGGA | 2037 | UCCACGUGGCGAACAUAAC | 2038 |
| 720 | UAUGUUCGCCACGUGGACA | 2039 | UGUCCACGUGGCGAACAUA | 2040 |
| 721 | AUGUUCGCCACGUGGACAA | 2041 | UUGUCCACGUGGCGAACAU | 2042 |
| 726 | CGCCACGUGGACAACCCCA | 2043 | UGGGGUUGUCCACGUGGCG | 2044 |
| 731 | CGUGGACAACCCCAACGGU | 2045 | ACCGUUGGGGUUGUCCACG | 2046 |
| 734 | GGACAACCCCAACGGUGAU | 2047 | AUCACCGUUGGGGUUGUCC | 2048 |
| 737 | CAACCCCAACGGUGAUGGU | 2049 | ACCAUCACCGUUGGGGUUG | 2050 |
| 741 | CCCAACGGUGAUGGUCGCU | 2051 | AGCGACCAUCACCGUUGGG | 2052 |
| 744 | AACGGUGAUGGUCGCUGCA | 2053 | UGCAGCGACCAUCACCGUU | 2054 |
| 765 | ACCUGCAUCUACUAUCUGA | 2055 | UCAGAUAGUAGAUGCAGGU | 2056 |
| 766 | CCUGCAUCUACUAUCUGAA | 2057 | UUCAGAUAGUAGAUGCAGG | 2058 |
| 787 | AGAAUUGGGAUGCCAAGCU | 2059 | AGCUUGGCAUCCCAAUUCU | 2060 |
| 788 | GAAUUGGGAUGCCAAGCUA | 2061 | UAGCUUGGCAUCCCAAUUC | 2062 |
| 790 | AUUGGGAUGCCAAGCUACA | 2063 | UGUAGCUUGGCAUCCCAAU | 2064 |
| 802 | AGCUACAUGGUGGGAUCCU | 2065 | AGGAUCCCACCAUGUAGCU | 2066 |

TABLE 6C-continued

Human EGNL3 Single Strands and Duplex Sequences

| Start | Sense Sequence (5' to 3') | SEQ ID NO. | Antisense Sequence (5' to 3') | SEQ ID NO. |
|---|---|---|---|---|
| 808 | AUGGUGGGAUCCUGCGGAU | 2067 | AUCCGCAGGAUCCCACCAU | 2068 |
| 809 | UGGUGGGAUCCUGCGGAUA | 2069 | UAUCCGCAGGAUCCCACCA | 2070 |
| 810 | GGUGGGAUCCUGCGGAUAU | 2071 | AUAUCCGCAGGAUCCCACC | 2072 |
| 811 | GUGGGAUCCUGCGGAUAUU | 2073 | AAUAUCCGCAGGAUCCCAC | 2074 |
| 812 | UGGGAUCCUGCGGAUAUUU | 2075 | AAAUAUCCGCAGGAUCCCA | 2076 |
| 815 | GAUCCUGCGGAUAUUUCCA | 2077 | UGGAAAUAUCCGCAGGAUC | 2078 |
| 817 | UCCUGCGGAUAUUUCCAGA | 2079 | UCUGGAAAUAUCCGCAGGA | 2080 |
| 822 | CGGAUAUUUCCAGAGGGGA | 2081 | UCCCCUCUGGAAAUAUCCG | 2082 |
| 833 | AGAGGGGAAAUCAUUCAUA | 2083 | UAUGAAUGAUUUCCCCUCU | 2084 |
| 836 | GGGGAAAUCAUUCAUAGCA | 2085 | UGCUAUGAAUGAUUUCCCC | 2086 |
| 839 | GAAAUCAUUCAUAGCAGAU | 2087 | AUCUGCUAUGAAUGAUUUC | 2088 |
| 858 | GUGGAGCCCAUUUUUGACA | 2089 | UGUCAAAAAUGGGCUCCAC | 2090 |
| 860 | GGAGCCCAUUUUUGACAGA | 2091 | UCUGUCAAAAAUGGGCUCC | 2092 |
| 862 | AGCCCAUUUUUGACAGACU | 2093 | AGUCUGUCAAAAAUGGGCU | 2094 |
| 868 | UUUUUGACAGACUCCUGUU | 2095 | AACAGGAGUCUGUCAAAAA | 2096 |
| 871 | UUGACAGACUCCUGUUCUU | 2097 | AAGAACAGGAGUCUGUCAA | 2098 |
| 873 | GACAGACUCCUGUUCUUCU | 2099 | AGAAGAACAGGAGUCUGUC | 2100 |
| 881 | CCUGUUCUUCUGGUCAGAU | 2101 | AUCUGACCAGAAGAACAGG | 2102 |
| 884 | GUUCUUCUGGUCAGAUCGU | 2103 | ACGAUCUGACCAGAAGAAC | 2104 |
| 885 | UUCUUCUGGUCAGAUCGUA | 2105 | UACGAUCUGACCAGAAGAA | 2106 |
| 888 | UUCUGGUCAGAUCGUAGGA | 2107 | UCCUACGAUCUGACCAGAA | 2108 |
| 889 | UCUGGUCAGAUCGUAGGAA | 2109 | UUCCUACGAUCUGACCAGA | 2110 |
| 893 | GUCAGAUCGUAGGAACCCA | 2111 | UGGGUUCCUACGAUCUGAC | 2112 |
| 895 | CAGAUCGUAGGAACCCACA | 2113 | UGUGGGUUCCUACGAUCUG | 2114 |
| 898 | AUCGUAGGAACCCACACGA | 2115 | UCGUGUGGGUUCCUACGAU | 2116 |
| 899 | UCGUAGGAACCCACACGAA | 2117 | UUCGUGUGGGUUCCUACGA | 2118 |
| 901 | GUAGGAACCCACACGAAGU | 2119 | ACUUCGUGUGGGUUCCUAC | 2120 |
| 904 | GGAACCCACACGAAGUGCA | 2121 | UGCACUUCGUGUGGGUUCC | 2122 |
| 917 | AGUGCAGCCCUCUUACGCA | 2123 | UGCGUAAGAGGGCUGCACU | 2124 |
| 918 | GUGCAGCCCUCUUACGCAA | 2125 | UUGCGUAAGAGGGCUGCAC | 2126 |
| 921 | CAGCCCUCUUACGCAACCA | 2127 | UGGUUGCGUAAGAGGGCUG | 2128 |
| 923 | GCCCUCUUACGCAACCAGA | 2129 | UCUGGUUGCGUAAGAGGGC | 2130 |
| 926 | CUCUUACGCAACCAGAUAU | 2131 | AUAUCUGGUUGCGUAAGAG | 2132 |
| 929 | UUACGCAACCAGAUAUGCU | 2133 | AGCAUAUCUGGUUGCGUAA | 2134 |
| 933 | GCAACCAGAUAUGCUAUGA | 2135 | UCAUAGCAUAUCUGGUUGC | 2136 |
| 935 | AACCAGAUAUGCUAUGACU | 2137 | AGUCAUAGCAUAUCUGGUU | 2138 |
| 937 | CCAGAUAUGCUAUGACUGU | 2139 | ACAGUCAUAGCAUAUCUGG | 2140 |

TABLE 6C-continued

Human EGNL3 Single Strands and Duplex Sequences

| Start | Sense Sequence (5' to 3') | SEQ ID NO. | Antisense Sequence (5' to 3') | SEQ ID NO. |
|---|---|---|---|---|
| 942 | UAUGCUAUGACUGUCUGGU | 2141 | ACCAGACAGUCAUAGCAUA | 2142 |
| 943 | AUGCUAUGACUGUCUGGUA | 2143 | UACCAGACAGUCAUAGCAU | 2144 |
| 946 | CUAUGACUGUCUGGUACUU | 2145 | AAGUACCAGACAGUCAUAG | 2146 |
| 955 | UCUGGUACUUUGAUGCUGA | 2147 | UCAGCAUCAAAGUACCAGA | 2148 |
| 974 | AGAAAGGGCAGAAGCCAAA | 2149 | UUUGGCUUCUGCCCUUUCU | 2150 |
| 978 | AGGGCAGAAGCCAAAAGA | 2151 | UCUUUUUGGCUUCUGCCCU | 2152 |
| 995 | GAAAUUCAGGAAUUUAACU | 2153 | AGUUAAAUUCCUGAAUUUC | 2154 |
| 996 | AAAUUCAGGAAUUUAACUA | 2155 | UAGUUAAAUUCCUGAAUUU | 2156 |
| 999 | UUCAGGAAUUUAACUAGGA | 2157 | UCCUAGUUAAAUUCCUGAA | 2158 |
| 1000 | UCAGGAAUUUAACUAGGAA | 2159 | UUCCUAGUUAAAUUCCUGA | 2160 |
| 1002 | AGGAAUUUAACUAGGAAAA | 2161 | UUUUCCUAGUUAAAUUCCU | 2162 |
| 1007 | UUUAACUAGGAAAACUGAA | 2163 | UUCAGUUUUCCUAGUUAAA | 2164 |
| 1015 | GGAAAACUGAAUCUGCCCU | 2165 | AGGGCAGAUUCAGUUUUCC | 2166 |
| 1019 | AACUGAAUCUGCCCUCACU | 2167 | AGUGAGGGCAGAUUCAGUU | 2168 |
| 1022 | UGAAUCUGCCCUCACUGAA | 2169 | UUCAGUGAGGGCAGAUUCA | 2170 |
| 1032 | CUCACUGAAGACUGACCGU | 2171 | ACGGUCAGUCUUCAGUGAG | 2172 |
| 1037 | UGAAGACUGACCGUGCUCU | 2173 | AGAGCACGGUCAGUCUUCA | 2174 |
| 1039 | AAGACUGACCGUGCUCUGA | 2175 | UCAGAGCACGGUCAGUCUU | 2176 |
| 1040 | AGACUGACCGUGCUCUGAA | 2177 | UUCAGAGCACGGUCAGUCU | 2178 |
| 1044 | UGACCGUGCUCUGAAAUCU | 2179 | AGAUUUCAGAGCACGGUCA | 2180 |
| 1052 | CUCUGAAAUCUGCUGGCCU | 2181 | AGGCCAGCAGAUUUCAGAG | 2182 |
| 1053 | UCUGAAAUCUGCUGGCCUU | 2183 | AAGGCCAGCAGAUUUCAGA | 2184 |
| 1060 | UCUGCUGGCCUUGUUCAUU | 2185 | AAUGAACAAGGCCAGCAGA | 2186 |
| 1062 | UGCUGGCCUUGUUCAUUUU | 2187 | AAAAUGAACAAGGCCAGCA | 2188 |
| 1071 | UGUUCAUUUUAGUAACGGU | 2189 | ACCGUUACUAAAAUGAACA | 2190 |
| 1072 | GUUCAUUUUAGUAACGGUU | 2191 | AACCGUUACUAAAAUGAAC | 2192 |
| 1075 | CAUUUUAGUAACGGUUCCU | 2193 | AGGAACCGUUACUAAAAUG | 2194 |
| 1078 | UUUAGUAACGGUUCCUGAA | 2195 | UUCAGGAACCGUUACUAAA | 2196 |
| 1079 | UUAGUAACGGUUCCUGAAU | 2197 | AUUCAGGAACCGUUACUAA | 2198 |
| 1080 | UAGUAACGGUUCCUGAAUU | 2199 | AAUUCAGGAACCGUUACUA | 2200 |
| 1082 | GUAACGGUUCCUGAAUUCU | 2201 | AGAAUUCAGGAACCGUUAC | 2202 |
| 1084 | AACGGUUCCUGAAUUCUCU | 2203 | AGAGAAUUCAGGAACCGUU | 2204 |
| 1088 | GUUCCUGAAUUCUCUUAAA | 2205 | UUUAAGAGAAUUCAGGAAC | 2206 |
| 1092 | CUGAAUUCUCUUAAAUUCU | 2207 | AGAAUUUAAGAGAAUUCAG | 2208 |
| 1112 | UGAGAUCCAAAGAUGGCCU | 2209 | AGGCCAUCUUUGGAUCUCA | 2210 |
| 1115 | GAUCCAAAGAUGGCCUCUU | 2211 | AAGAGGCCAUCUUUGGAUC | 2212 |
| 1119 | CAAAGAUGGCCUCUUCAGU | 2213 | ACUGAAGAGGCCAUCUUUG | 2214 |

TABLE 6C-continued

Human EGNL3 Single Strands and Duplex Sequences

| Start | Sense Sequence (5' to 3') | SEQ ID NO. | Antisense Sequence (5' to 3') | SEQ ID NO. |
|---|---|---|---|---|
| 1137 | UGACAACAAUCUCCCUGCU | 2215 | AGCAGGGAGAUUGUUGUCA | 2216 |
| 1141 | AACAAUCUCCCUGCUACUU | 2217 | AAGUAGCAGGGAGAUUGUU | 2218 |
| 1148 | UCCCUGCUACUUCUUGCAU | 2219 | AUGCAAGAAGUAGCAGGGA | 2220 |
| 1151 | CUGCUACUUCUUGCAUCCU | 2221 | AGGAUGCAAGAAGUAGCAG | 2222 |
| 1152 | UGCUACUUCUUGCAUCCUU | 2223 | AAGGAUGCAAGAAGUAGCA | 2224 |
| 1176 | CCCUGUCUUGUGUGUGGUA | 2225 | UACCACACAAGACAGGG | 2226 |
| 1181 | UCUUGUGUGUGGUACUUCA | 2227 | UGAAGUACCACACACAAGA | 2228 |
| 1182 | CUUGUGUGUGGUACUUCAU | 2229 | AUGAAGUACCACACACAAG | 2230 |
| 1186 | UGUGUGGUACUUCAUGUUU | 2231 | AAACAUGAAGUACCACACA | 2232 |
| 1194 | ACUUCAUGUUUCUUGCCA | 2233 | UGGCAAGAAACAUGAAGU | 2234 |
| 1201 | GUUUCUUGCCAAGACUGU | 2235 | ACAGUCUUGGCAAGAAAC | 2236 |
| 1204 | UUCUUGCCAAGACUGUGUU | 2237 | AACACAGUCUUGGCAAGAA | 2238 |
| 1218 | GUGUUGAUCUUCAGAUACU | 2239 | AGUAUCUGAAGAUCAACAC | 2240 |
| 1222 | UGAUCUUCAGAUACUCUCU | 2241 | AGAGAGUAUCUGAAGAUCA | 2242 |
| 1228 | UCAGAUACUCUCUUUGCCA | 2243 | UGGCAAAGAGAGUAUCUGA | 2244 |
| 1230 | AGAUACUCUCUUUGCCAGA | 2245 | UCUGGCAAAGAGAGUAUCU | 2246 |
| 1233 | UACUCUCUUUGCCAGAUGA | 2247 | UCAUCUGGCAAAGAGAGUA | 2248 |
| 1234 | ACUCUCUUUGCCAGAUGAA | 2249 | UUCAUCUGGCAAAGAGAGU | 2250 |
| 1241 | UUGCCAGAUGAAGUUACUU | 2251 | AAGUAACUUCAUCUGGCAA | 2252 |
| 1245 | CAGAUGAAGUUACUUGCUA | 2253 | UAGCAAGUAACUUCAUCUG | 2254 |
| 1246 | AGAUGAAGUUACUUGCUAA | 2255 | UUAGCAAGUAACUUCAUCU | 2256 |
| 1248 | AUGAAGUUACUUGCUAACU | 2257 | AGUUAGCAAGUAACUUCAU | 2258 |
| 1251 | AAGUUACUUGCUAACUCCA | 2259 | UGGAGUUAGCAAGUAACUU | 2260 |
| 1255 | UACUUGCUAACUCCAGAAA | 2261 | UUUCUGGAGUUAGCAAGUA | 2262 |
| 1260 | GCUAACUCCAGAAAUUCCU | 2263 | AGGAAUUUCUGGAGUUAGC | 2264 |
| 1272 | AAUUCCUGCAGACAUCCUA | 2265 | UAGGAUGUCUGCAGGAAUU | 2266 |
| 1274 | UUCCUGCAGACAUCCUACU | 2267 | AGUAGGAUGUCUGCAGGAA | 2268 |
| 1287 | CCUACUCGGCCAGCGGUUU | 2269 | AAACCGCUGGCCGAGUAGG | 2270 |
| 1288 | CUACUCGGCCAGCGGUUUA | 2271 | UAAACCGCUGGCCGAGUAG | 2272 |
| 1291 | CUCGGCCAGCGGUUUACCU | 2273 | AGGUAAACCGCUGGCCGAG | 2274 |
| 1294 | GGCCAGCGGUUUACCUGAU | 2275 | AUCAGGUAAACCGCUGGCC | 2276 |
| 1295 | GCCAGCGGUUUACCUGAUA | 2277 | UAUCAGGUAAACCGCUGGC | 2278 |
| 1297 | CAGCGGUUUACCUGAUAGA | 2279 | UCUAUCAGGUAAACCGCUG | 2280 |
| 1298 | AGCGGUUUACCUGAUAGAU | 2281 | AUCUAUCAGGUAAACCGCU | 2282 |
| 1299 | GCGGUUUACCUGAUAGAUU | 2283 | AAUCUAUCAGGUAAACCGC | 2284 |
| 1303 | UUUACCUGAUAGAUUCGGU | 2285 | ACCGAAUCUAUCAGGUAAA | 2286 |
| 1304 | UUACCUGAUAGAUUCGGUA | 2287 | UACCGAAUCUAUCAGGUAA | 2288 |

TABLE 6C-continued

Human EGNL3 Single Strands and Duplex Sequences

| Start | Sense Sequence (5' to 3') | SEQ ID NO. | Antisense Sequence (5' to 3') | SEQ ID NO. |
|---|---|---|---|---|
| 1305 | UACCUGAUAGAUUCGGUAA | 2289 | UUACCGAAUCUAUCAGGUA | 2290 |
| 1306 | ACCUGAUAGAUUCGGUAAU | 2291 | AUUACCGAAUCUAUCAGGU | 2292 |
| 1307 | CCUGAUAGAUUCGGUAAUA | 2293 | UAUUACCGAAUCUAUCAGG | 2294 |
| 1309 | UGAUAGAUUCGGUAAUACU | 2295 | AGUAUUACCGAAUCUAUCA | 2296 |
| 1310 | GAUAGAUUCGGUAAUACUA | 2297 | UAGUAUUACCGAAUCUAUC | 2298 |
| 1313 | AGAUUCGGUAAUACUAUCA | 2299 | UGAUAGUAUUACCGAAUCU | 2300 |
| 1325 | ACUAUCAAGAGAAGAGCCU | 2301 | AGGCUCUUCUCUUGAUAGU | 2302 |
| 1329 | UCAAGAGAAGAGCCUAGGA | 2303 | UCCUAGGCUCUUCUCUUGA | 2304 |
| 1344 | AGGAGCACAGCGAGGGAAU | 2305 | AUUCCCUCGCUGUGCUCCU | 2306 |
| 1346 | GAGCACAGCGAGGGAAUGA | 2307 | UCAUUCCCUCGCUGUGCUC | 2308 |
| 1347 | AGCACAGCGAGGGAAUGAA | 2309 | UUCAUUCCCUCGCUGUGCU | 2310 |
| 1350 | ACAGCGAGGGAAUGAACCU | 2311 | AGGUUCAUUCCCUCGCUGU | 2312 |
| 1351 | CAGCGAGGGAAUGAACCUU | 2313 | AAGGUUCAUUCCCUCGCUG | 2314 |
| 1352 | AGCGAGGGAAUGAACCUUA | 2315 | UAAGGUUCAUUCCCUCGCU | 2316 |
| 1360 | AAUGAACCUUACUUGCACU | 2317 | AGUGCAAGUAAGGUUCAUU | 2318 |
| 1361 | AUGAACCUUACUUGCACUU | 2319 | AAGUGCAAGUAAGGUUCAU | 2320 |
| 1362 | UGAACCUUACUUGCACUUU | 2321 | AAAGUGCAAGUAAGGUUCA | 2322 |
| 1367 | CUUACUUGCACUUUAUGUA | 2323 | UACAUAAAGUGCAAGUAAG | 2324 |
| 1368 | UUACUUGCACUUUAUGUAU | 2325 | AUACAUAAAGUGCAAGUAA | 2326 |
| 1375 | CACUUUAUGUAUACUUCCU | 2327 | AGGAAGUAUACAUAAAGUG | 2328 |
| 1378 | UUUAUGUAUACUUCCUGAU | 2329 | AUCAGGAAGUAUACAUAAA | 2330 |
| 1379 | UUAUGUAUACUUCCUGAUU | 2331 | AAUCAGGAAGUAUACAUAA | 2332 |
| 1383 | GUAUACUUCCUGAUUUGAA | 2333 | UUCAAAUCAGGAAGUAUAC | 2334 |
| 1384 | UAUACUUCCUGAUUUGAAA | 2335 | UUUCAAAUCAGGAAGUAUA | 2336 |
| 1395 | AUUUGAAAGGAGGAGGUUU | 2337 | AAACCUCCUCCUUUCAAAU | 2338 |
| 1397 | UUGAAAGGAGGAGGUUUGA | 2339 | UCAAACCUCCUCCUUUCAA | 2340 |
| 1419 | GAAAAAAUGGAGGUGGUA | 2341 | UACCACCUCCAUUUUUUUC | 2342 |
| 1422 | AAAAUGGAGGUGGUAGAU | 2343 | AUCUACCACCUCCAUUUUU | 2344 |
| 1428 | GGAGGUGGUAGAUGCCACA | 2345 | UGUGGCAUCUACCACCUCC | 2346 |
| 1436 | UAGAUGCCACAGAGAGGCA | 2347 | UGCCUCUCUGUGGCAUCUA | 2348 |
| 1443 | CACAGAGAGGCAUCACGGA | 2349 | UCCGUGAUGCCUCUCUGUG | 2350 |
| 1451 | GGCAUCACGGAAGCCUUAA | 2351 | UUAAGGCUUCCGUGAUGCC | 2352 |
| 1453 | CAUCACGGAAGCCUUAACA | 2353 | UGUUAAGGCUUCCGUGAUG | 2354 |
| 1456 | CACGGAAGCCUUAACAGCA | 2355 | UGCUGUUAAGGCUUCCGUG | 2356 |
| 1476 | GAAACAGAGAAAUUUGUGU | 2357 | ACACAAAUUUCUCUGUUUC | 2358 |
| 1487 | AUUUGUGUCAUCUGAACAA | 2359 | UUGUUCAGAUGACACAAAU | 2360 |
| 1499 | UGAACAAUUUCCAGAUGUU | 2361 | AACAUCUGGAAAUUGUUCA | 2362 |

TABLE 6C-continued

Human EGNL3 Single Strands and Duplex Sequences

| Start | Sense Sequence (5' to 3') | SEQ ID NO. | Antisense Sequence (5' to 3') | SEQ ID NO. |
|---|---|---|---|---|
| 1501 | AACAAUUUCCAGAUGUUCU | 2363 | AGAACAUCUGGAAAUUGUU | 2364 |
| 1502 | ACAAUUUCCAGAUGUUCUU | 2365 | AAGAACAUCUGGAAAUUGU | 2366 |
| 1504 | AAUUUCCAGAUGUUCUUAA | 2367 | UUAAGAACAUCUGGAAAUU | 2368 |
| 1513 | AUGUUCUUAAUCCAGGGCU | 2369 | AGCCCUGGAUUAAGAACAU | 2370 |
| 1534 | UGGGGUUUCUGGAGAAUUA | 2371 | UAAUUCUCCAGAAACCCCA | 2372 |
| 1539 | UUUCUGGAGAAUUAUCACA | 2373 | UGUGAUAAUUCUCCAGAAA | 2374 |
| 1543 | UGGAGAAUUAUCACAACCU | 2375 | AGGUUGUGAUAAUUCUCCA | 2376 |
| 1544 | GGAGAAUUAUCACAACCUA | 2377 | UAGGUUGUGAUAAUUCUCC | 2378 |
| 1545 | GAGAAUUAUCACAACCUAA | 2379 | UUAGGUUGUGAUAAUUCUC | 2380 |
| 1546 | AGAAUUAUCACAACCUAAU | 2381 | AUUAGGUUGUGAUAAUUCU | 2382 |
| 1548 | AAUUAUCACAACCUAAUGA | 2383 | UCAUUAGGUUGUGAUAAUU | 2384 |
| 1552 | AUCACAACCUAAUGACAUU | 2385 | AAUGUCAUUAGGUUGUGAU | 2386 |
| 1553 | UCACAACCUAAUGACAUUA | 2387 | UAAUGUCAUUAGGUUGUGA | 2388 |
| 1559 | CCUAAUGACAUUAAUACCU | 2389 | AGGUAUUAAUGUCAUUAGG | 2390 |
| 1561 | UAAUGACAUUAAUACCUCU | 2391 | AGAGGUAUUAAUGUCAUUA | 2392 |
| 1565 | GACAUUAAUACCUCUAGAA | 2393 | UUCUAGAGGUAUUAAUGUC | 2394 |
| 1571 | AAUACCUCUAGAAAGGGCU | 2395 | AGCCCUUUCUAGAGGUAUU | 2396 |
| 1582 | AAAGGGCUGCUGUCAUAGU | 2397 | ACUAUGACAGCAGCCCUUU | 2398 |
| 1584 | AGGGCUGCUGUCAUAGUGA | 2399 | UCACUAUGACAGCAGCCCU | 2400 |
| 1585 | GGGCUGCUGUCAUAGUGAA | 2401 | UUCACUAUGACAGCAGCCC | 2402 |
| 1587 | GCUGCUGUCAUAGUGAACA | 2403 | UGUUCACUAUGACAGCAGC | 2404 |
| 1589 | UGCUGUCAUAGUGAACAAU | 2405 | AUUGUUCACUAUGACAGCA | 2406 |
| 1594 | UCAUAGUGAACAAUUUAUA | 2407 | UAUAAAUUGUUCACUAUGA | 2408 |
| 1595 | CAUAGUGAACAAUUUAUAA | 2409 | UUAUAAAUUGUUCACUAUG | 2410 |
| 1610 | AUAAGUGUCCCAUGGGGCA | 2411 | UGCCCCAUGGGACACUUAU | 2412 |
| 1620 | CAUGGGGCAGACACUCCUU | 2413 | AAGGAGUGUCUGCCCCAUG | 2414 |
| 1621 | AUGGGGCAGACACUCCUUU | 2415 | AAAGGAGUGUCUGCCCCAU | 2416 |
| 1623 | GGGGCAGACACUCCUUUUU | 2417 | AAAAAGGAGUGUCUGCCCC | 2418 |
| 1624 | GGGCAGACACUCCUUUUUU | 2419 | AAAAAAGGAGUGUCUGCCC | 2420 |
| 1636 | CUUUUUUCCCAGUCCUGCA | 2421 | UGCAGGACUGGGAAAAAAG | 2422 |
| 1640 | UUUCCCAGUCCUGCAACCU | 2423 | AGGUUGCAGGACUGGGAAA | 2424 |
| 1645 | CAGUCCUGCAACCUGGAUU | 2425 | AAUCCAGGUUGCAGGACUG | 2426 |
| 1647 | GUCCUGCAACCUGGAUUUU | 2427 | AAAAUCCAGGUUGCAGGAC | 2428 |
| 1653 | CAACCUGGAUUUUCUGCCU | 2429 | AGGCAGAAAAUCCAGGUUG | 2430 |
| 1670 | CUCAGCCCCAUUUUGCUGA | 2431 | UCAGCAAAAUGGGGCUGAG | 2432 |
| 1694 | AUGACUUUCUGAAUAAAGA | 2433 | UCUUUAUUCAGAAAGUCAU | 2434 |
| 1695 | UGACUUUCUGAAUAAAGAU | 2435 | AUCUUUAUUCAGAAAGUCA | 2436 |

TABLE 6C-continued

Human EGNL3 Single Strands and Duplex Sequences

| Start | Sense Sequence (5' to 3') | SEQ ID NO. | Antisense Sequence (5' to 3') | SEQ ID NO. |
|---|---|---|---|---|
| 1704 | GAAUAAAGAUGGCAACACA | 2437 | UGUGUUGCCAUCUUUAUUC | 2438 |
| 1732 | CCAUUUUCAGUUCUUACCU | 2439 | AGGUAAGAACUGAAAAUGG | 2440 |
| 1736 | UUUCAGUUCUUACCUGGGA | 2441 | UCCCAGGUAAGAACUGAAA | 2442 |
| 1737 | UUCAGUUCUUACCUGGGAA | 2443 | UUCCCAGGUAAGAACUGAA | 2444 |
| 1741 | GUUCUUACCUGGGAACCUA | 2445 | UAGGUUCCCAGGUAAGAAC | 2446 |
| 1742 | UUCUUACCUGGGAACCUAA | 2447 | UUAGGUUCCCAGGUAAGAA | 2448 |
| 1743 | UCUUACCUGGGAACCUAAU | 2449 | AUUAGGUUCCCAGGUAAGA | 2450 |
| 1744 | CUUACCUGGGAACCUAAUU | 2451 | AAUUAGGUUCCCAGGUAAG | 2452 |
| 1749 | CUGGGAACCUAAUUCCCCA | 2453 | UGGGGAAUUAGGUUCCCAG | 2454 |
| 1751 | GGGAACCUAAUUCCCCAGA | 2455 | UCUGGGGAAUUAGGUUCCC | 2456 |
| 1752 | GGAACCUAAUUCCCCAGAA | 2457 | UUCUGGGGAAUUAGGUUCC | 2458 |
| 1757 | CUAAUUCCCCAGAAGCUAA | 2459 | UUAGCUUCUGGGGAAUUAG | 2460 |
| 1758 | UAAUUCCCCAGAAGCUAAA | 2461 | UUUAGCUUCUGGGGAAUUA | 2462 |
| 1759 | AAUUCCCCAGAAGCUAAAA | 2463 | UUUUAGCUUCUGGGGAAUU | 2464 |
| 1760 | AUUCCCCAGAAGCUAAAAA | 2465 | UUUUUAGCUUCUGGGGAAU | 2466 |
| 1763 | CCCCAGAAGCUAAAAAACU | 2467 | AGUUUUUUAGCUUCUGGGG | 2468 |
| 1764 | CCCAGAAGCUAAAAAACUA | 2469 | UAGUUUUUUAGCUUCUGGG | 2470 |
| 1776 | AAAACUAGACAUUAGUUGU | 2471 | ACAACUAAUGUCUAGUUUU | 2472 |
| 1777 | AAACUAGACAUUAGUUGUU | 2473 | AACAACUAAUGUCUAGUUU | 2474 |
| 1778 | AACUAGACAUUAGUUGUUU | 2475 | AAACAACUAAUGUCUAGUU | 2476 |
| 1779 | ACUAGACAUUAGUUGUUUU | 2477 | AAAACAACUAAUGUCUAGU | 2478 |
| 1782 | AGACAUUAGUUGUUUUGGU | 2479 | ACCAAAACAACUAAUGUCU | 2480 |
| 1783 | GACAUUAGUUGUUUUGGUU | 2481 | AACCAAAACAACUAAUGUC | 2482 |
| 1788 | UAGUUGUUUUGGUUGCUUU | 2483 | AAAGCAACCAAAACAACUA | 2484 |
| 1791 | UUGUUUUGGUUGCUUUGUU | 2485 | AACAAAGCAACCAAAACAA | 2486 |
| 1844 | AUAUCCCUGGUAGUUUUGU | 2487 | ACAAAACUACCAGGGAUAU | 2488 |
| 1847 | UCCCUGGUAGUUUUGUGUU | 2489 | AACACAAAACUACCAGGGA | 2490 |
| 1849 | CCUGGUAGUUUUGUGUUAA | 2491 | UUAACACAAAACUACCAGG | 2492 |
| 1854 | UAGUUUUGUGUUAACCACU | 2493 | AGUGGUUAACACAAAACUA | 2494 |
| 1861 | GUGUUAACCACUGAUAACU | 2495 | AGUUAUCAGUGGUUAACAC | 2496 |
| 1863 | GUUAACCACUGAUAACUGU | 2497 | ACAGUUAUCAGUGGUUAAC | 2498 |
| 1868 | CCACUGAUAACUGUGGAAA | 2499 | UUUCCACAGUUAUCAGUGG | 2500 |
| 1870 | ACUGAUAACUGUGGAAAGA | 2501 | UCUUUCCACAGUUAUCAGU | 2502 |
| 1882 | GGAAAGAGCUAGGUCUACU | 2503 | AGUAGACCUAGCUCUUUCC | 2504 |
| 1888 | AGCUAGGUCUACUGAUAUA | 2505 | UAUAUCAGUAGACCUAGCU | 2506 |
| 1890 | CUAGGUCUACUGAUAUACA | 2507 | UGUAUAUCAGUAGACCUAG | 2508 |
| 1893 | GGUCUACUGAUAUACAAUA | 2509 | UAUUGUAUAUCAGUAGACC | 2510 |

TABLE 6C-continued

Human EGNL3 Single Strands and Duplex Sequences

| Start | Sense Sequence (5' to 3') | SEQ ID NO. | Antisense Sequence (5' to 3') | SEQ ID NO. |
|---|---|---|---|---|
| 1894 | GUCUACUGAUAUACAAUAA | 2511 | UUAUUGUAUAUCAGUAGAC | 2512 |
| 1895 | UCUACUGAUAUACAAUAAA | 2513 | UUUAUUGUAUAUCAGUAGA | 2514 |
| 1897 | UACUGAUAUACAAUAAACA | 2515 | UGUUUAUUGUAUAUCAGUA | 2516 |
| 1905 | UACAAUAAACAUGUGUGCA | 2517 | UGCACACAUGUUUAUUGUA | 2518 |
| 1911 | AAACAUGUGUGCAUCUUGA | 2519 | UCAAGAUGCACACAUGUUU | 2520 |
| 1915 | AUGUGUGCAUCUUGAACAA | 2521 | UUGUUCAAGAUGCACACAU | 2522 |
| 1916 | UGUGUGCAUCUUGAACAAU | 2523 | AUUGUUCAAGAUGCACACA | 2524 |
| 1917 | GUGUGCAUCUUGAACAAUU | 2525 | AAUUGUUCAAGAUGCACAC | 2526 |
| 1922 | CAUCUUGAACAAUUUGAGA | 2527 | UCUCAAAUUGUUCAAGAUG | 2528 |
| 1927 | UGAACAAUUUGAGAGGGGA | 2529 | UCCCCUCUCAAAUUGUUCA | 2530 |
| 1930 | ACAAUUUGAGAGGGGAGGU | 2531 | ACCUCCCCUCUCAAAUUGU | 2532 |
| 1954 | UGGAAAUGUGGGUGUUCCU | 2533 | AGGAACACCCACAUUUCCA | 2534 |
| 1958 | AAUGGGGUGUUCCUGUUU | 2535 | AAACAGGAACACCCACAUU | 2536 |
| 1962 | UGGGUGUUCCUGUUUUUUU | 2537 | AAAAAAACAGGAACACCCA | 2538 |
| 2007 | UUAAUGAGCUCACCCUUUA | 2539 | UAAAGGGUGAGCUCAUUAA | 2540 |
| 2008 | UAAUGAGCUCACCCUUUAA | 2541 | UUAAAGGGUGAGCUCAUUA | 2542 |
| 2010 | AUGAGCUCACCCUUUAACA | 2543 | UGUUAAAGGGUGAGCUCAU | 2544 |
| 2012 | GAGCUCACCCUUUAACACA | 2545 | UGUGUUAAAGGGUGAGCUC | 2546 |
| 2014 | GCUCACCCUUUAACACAAA | 2547 | UUUGUGUUAAAGGGUGAGC | 2548 |
| 2016 | UCACCCUUUAACACAAAAA | 2549 | UUUUUGUGUUAAAGGGUGA | 2550 |
| 2017 | CACCCUUUAACACAAAAAA | 2551 | UUUUUUGUGUUAAAGGGUG | 2552 |
| 2021 | CUUUAACACAAAAAAGCA | 2553 | UGCUUUUUUUGUGUUAAAG | 2554 |
| 2028 | ACAAAAAAGCAAGGUGAU | 2555 | AUCACCUUGCUUUUUUUGU | 2556 |
| 2044 | GAUGUAUUUUAAAAAAGGA | 2557 | UCCUUUUUUAAAAUACAUC | 2558 |
| 2060 | GGAAGUGGAAAUAAAAAAA | 2559 | UUUUUUUAUUUCCACUUCC | 2560 |
| 2072 | AAAAAAAUCUCAAAGCUAU | 2561 | AUAGCUUUGAGAUUUUUUU | 2562 |
| 2073 | AAAAAAUCUCAAAGCUAUU | 2563 | AAUAGCUUUGAGAUUUUUU | 2564 |
| 2081 | UCAAAGCUAUUUGAGUUCU | 2565 | AGAACUCAAAUAGCUUUGA | 2566 |
| 2084 | AAGCUAUUUGAGUUCUCGU | 2567 | ACGAGAACUCAAAUAGCUU | 2568 |
| 2086 | GCUAUUUGAGUUCUCGUCU | 2569 | AGACGAGAACUCAAAUAGC | 2570 |
| 2098 | CUCGUCUGUCCCUAGCAGU | 2571 | ACUGCUAGGGACAGACGAG | 2572 |
| 2100 | CGUCUGUCCCUAGCAGUCU | 2573 | AGACUGCUAGGGACAGACG | 2574 |
| 2105 | GUCCCUAGCAGUCUUUCUU | 2575 | AAGAAAGACUGCUAGGGAC | 2576 |
| 2121 | CUUCAGCUCACUUGGCUCU | 2577 | AGAGCCAAGUGAGCUGAAG | 2578 |
| 2123 | UCAGCUCACUUGGCUCUCU | 2579 | AGAGAGCCAAGUGAGCUGA | 2580 |
| 2124 | CAGCUCACUUGGCUCUCUA | 2581 | UAGAGAGCCAAGUGAGCUG | 2582 |
| 2132 | UUGGCUCUCUAGAUCCACU | 2583 | AGUGGAUCUAGAGAGCCAA | 2584 |

TABLE 6C-continued

Human EGNL3 Single Strands and Duplex Sequences

| Start | Sense Sequence (5' to 3') | SEQ ID NO. | Antisense Sequence (5' to 3') | SEQ ID NO. |
|---|---|---|---|---|
| 2134 | GGCUCUCUAGAUCCACUGU | 2585 | ACAGUGGAUCUAGAGAGCC | 2586 |
| 2137 | UCUCUAGAUCCACUGUGGU | 2587 | ACCACAGUGGAUCUAGAGA | 2588 |
| 2142 | AGAUCCACUGUGGUUGGCA | 2589 | UGCCAACCACAGUGGAUCU | 2590 |
| 2144 | AUCCACUGUGGUUGGCAGU | 2591 | ACUGCCAACCACAGUGGAU | 2592 |
| 2145 | UCCACUGUGGUUGGCAGUA | 2593 | UACUGCCAACCACAGUGGA | 2594 |
| 2146 | CCACUGUGGUUGGCAGUAU | 2595 | AUACUGCCAACCACAGUGG | 2596 |
| 2155 | UUGGCAGUAUGACCAGAAU | 2597 | AUUCUGGUCAUACUGCCAA | 2598 |
| 2157 | GGCAGUAUGACCAGAAUCA | 2599 | UGAUUCUGGUCAUACUGCC | 2600 |
| 2161 | GUAUGACCAGAAUCAUGGA | 2601 | UCCAUGAUUCUGGUCAUAC | 2602 |
| 2171 | AAUCAUGGAAUUUGCUAGA | 2603 | UCUAGCAAAUUCCAUGAUU | 2604 |
| 2172 | AUCAUGGAAUUUGCUAGAA | 2605 | UUCUAGCAAAUUCCAUGAU | 2606 |
| 2176 | UGGAAUUUGCUAGAACUGU | 2607 | ACAGUUCUAGCAAAUUCCA | 2608 |
| 2180 | AUUUGCUAGAACUGUGGAA | 2609 | UUCCACAGUUCUAGCAAAU | 2610 |
| 2184 | GCUAGAACUGUGGAAGCUU | 2611 | AAGCUUCCACAGUUCUAGC | 2612 |
| 2198 | AGCUUCUACUCCUGCAGUA | 2613 | UACUGCAGGAGUAGAAGCU | 2614 |
| 2199 | GCUUCUACUCCUGCAGUAA | 2615 | UUACUGCAGGAGUAGAAGC | 2616 |
| 2206 | CUCCUGCAGUAAGCACAGA | 2617 | UCUGUGCUUACUGCAGGAG | 2618 |
| 2217 | AGCACAGAUCGCACUGCCU | 2619 | AGGCAGUGCGAUCUGUGCU | 2620 |
| 2220 | ACAGAUCGCACUGCCUCAA | 2621 | UUGAGGCAGUGCGAUCUGU | 2622 |
| 2221 | CAGAUCGCACUGCCUCAAU | 2623 | AUUGAGGCAGUGCGAUCUG | 2624 |
| 2222 | AGAUCGCACUGCCUCAAUA | 2625 | UAUUGAGGCAGUGCGAUCU | 2626 |
| 2223 | GAUCGCACUGCCUCAAUAA | 2627 | UUAUUGAGGCAGUGCGAUC | 2628 |
| 2229 | ACUGCCUCAAUAACUUGGU | 2629 | ACCAAGUUAUUGAGGCAGU | 2630 |
| 2231 | UGCCUCAAUAACUUGGUAU | 2631 | AUACCAAGUUAUUGAGGCA | 2632 |
| 2237 | AAUAACUUGGUAUUGAGCA | 2633 | UGCUCAAUACCAAGUUAUU | 2634 |
| 2240 | AACUUGGUAUUGAGCACGU | 2635 | ACGUGCUCAAUACCAAGUU | 2636 |
| 2243 | UUGGUAUUGAGCACGUAUU | 2637 | AAUACGUGCUCAAUACCAA | 2638 |
| 2255 | ACGUAUUUGCAAAAGCUA | 2639 | UAGCUUUUGCAAAAUACGU | 2640 |
| 2257 | GUAUUUGCAAAAGCUACU | 2641 | AGUAGCUUUUGCAAAAUAC | 2642 |
| 2258 | UAUUUGCAAAAGCUACUU | 2643 | AAGUAGCUUUUGCAAAAUA | 2644 |
| 2259 | AUUUUGCAAAAGCUACUUU | 2645 | AAAGUAGCUUUUGCAAAAU | 2646 |
| 2268 | AAGCUACUUUUCCUAGUUU | 2647 | AAACUAGGAAAAGUAGCUU | 2648 |
| 2271 | CUACUUUUCCUAGUUUUCA | 2649 | UGAAAACUAGGAAAAGUAG | 2650 |
| 2279 | CCUAGUUUUCAGUAUUACU | 2651 | AGUAAUACUGAAAACUAGG | 2652 |
| 2280 | CUAGUUUUCAGUAUUACUU | 2653 | AAGUAAUACUGAAAACUAG | 2654 |
| 2312 | AUCCCUUUAAUUUCUUGCU | 2655 | AGCAAGAAAUUAAAGGGAU | 2656 |
| 2326 | UUGCUUGAAAAUCCCAUGA | 2657 | UCAUGGGAUUUUCAAGCAA | 2658 |

TABLE 6C-continued

Human EGNL3 Single Strands and Duplex Sequences

| Start | Sense Sequence (5' to 3') | SEQ ID NO. | Antisense Sequence (5' to 3') | SEQ ID NO. |
|---|---|---|---|---|
| 2327 | UGCUUGAAAAUCCCAUGAA | 2659 | UUCAUGGGAUUUUCAAGCA | 2660 |
| 2329 | CUUGAAAAUCCCAUGAACA | 2661 | UGUUCAUGGGAUUUUCAAG | 2662 |
| 2343 | GAACAUUAAAGAGCCAGAA | 2663 | UUCUGGCUCUUUAAUGUUC | 2664 |
| 2346 | CAUUAAAGAGCCAGAAAUA | 2665 | UAUUUCUGGCUCUUUAAUG | 2666 |
| 2355 | GCCAGAAAUAUUUCCUUU | 2667 | AAAGGAAAAUAUUUCUGGC | 2668 |
| 2367 | UUCCUUUGUUAUGUACGGA | 2669 | UCCGUACAUAACAAAGGAA | 2670 |
| 2368 | UCCUUUGUUAUGUACGGAU | 2671 | AUCCGUACAUAACAAAGGA | 2672 |
| 2369 | CCUUUGUUAUGUACGGAUA | 2673 | UAUCCGUACAUAACAAAGG | 2674 |
| 2370 | CUUUGUUAUGUACGGAUAU | 2675 | AUAUCCGUACAUAACAAAG | 2676 |
| 2371 | UUUGUUAUGUACGGAUAUA | 2677 | UAUAUCCGUACAUAACAAA | 2678 |
| 2372 | UUGUUAUGUACGGAUAUAU | 2679 | AUAUAUCCGUACAUAACAA | 2680 |
| 2373 | UGUUAUGUACGGAUAUAUA | 2681 | UAUAUAUCCGUACAUAACA | 2682 |
| 2394 | UAUAUAGUCUUCCAAGAUA | 2683 | UAUCUUGGAAGACUAUAUA | 2684 |
| 2401 | UCUUCCAAGAUAGAAGUUU | 2685 | AAACUUCUAUCUUGGAAGA | 2686 |
| 2404 | UCCAAGAUAGAAGUUUACU | 2687 | AGUAAACUUCUAUCUUGGA | 2688 |
| 2405 | CCAAGAUAGAAGUUUACUU | 2689 | AAGUAAACUUCUAUCUUGG | 2690 |
| 2448 | UUCCAGAUAAGACAUGUCA | 2691 | UGACAUGUCUUAUCUGGAA | 2692 |
| 2454 | AUAAGACAUGUCACCAUUA | 2693 | UAAUGGUGACAUGUCUUAU | 2694 |
| 2456 | AAGACAUGUCACCAUUAAU | 2695 | AUUAAUGGUGACAUGUCUU | 2696 |
| 2459 | ACAUGUCACCAUUAAUUCU | 2697 | AGAAUUAAUGGUGACAUGU | 2698 |
| 2461 | AUGUCACCAUUAAUUCUCA | 2699 | UGAGAAUUAAUGGUGACAU | 2700 |
| 2462 | UGUCACCAUUAAUUCUCAA | 2701 | UUGAGAAUUAAUGGUGACA | 2702 |
| 2465 | CACCAUUAAUUCUCAACGA | 2703 | UCGUUGAGAAUUAAUGGUG | 2704 |
| 2467 | CCAUUAAUUCUCAACGACU | 2705 | AGUCGUUGAGAAUUAAUGG | 2706 |
| 2470 | UUAAUUCUCAACGACUGCU | 2707 | AGCAGUCGUUGAGAAUUAA | 2708 |
| 2472 | AAUUCUCAACGACUGCUCU | 2709 | AGAGCAGUCGUUGAGAAUU | 2710 |
| 2474 | UUCUCAACGACUGCUCUAU | 2711 | AUAGAGCAGUCGUUGAGAA | 2712 |
| 2475 | UCUCAACGACUGCUCUAUU | 2713 | AAUAGAGCAGUCGUUGAGA | 2714 |
| 2476 | CUCAACGACUGCUCUAUUU | 2715 | AAAUAGAGCAGUCGUUGAG | 2716 |
| 2479 | AACGACUGCUCUAUUUUGU | 2717 | ACAAAAUAGAGCAGUCGUU | 2718 |
| 2488 | UCUAUUUUGUUGUACGGUA | 2719 | UACCGUACAACAAAAUAGA | 2720 |
| 2490 | UAUUUUGUUGUACGGUAAU | 2721 | AUUACCGUACAACAAAAUA | 2722 |
| 2491 | AUUUUGUUGUACGGUAAUA | 2723 | UAUUACCGUACAACAAAAU | 2724 |
| 2493 | UUUGUUGUACGGUAAUAGU | 2725 | ACUAUUACCGUACAACAAA | 2726 |
| 2494 | UUGUUGUACGGUAAUAGUU | 2727 | AACUAUUACCGUACAACAA | 2728 |
| 2495 | UGUUGUACGGUAAUAGUUA | 2729 | UAACUAUUACCGUACAACA | 2730 |
| 2496 | GUUGUACGGUAAUAGUUAU | 2731 | AUAACUAUUACCGUACAAC | 2732 |

TABLE 6C-continued

Human EGNL3 Single Strands and Duplex Sequences

| Start | Sense Sequence (5' to 3') | SEQ ID NO. | Antisense Sequence (5' to 3') | SEQ ID NO. |
|---|---|---|---|---|
| 2501 | ACGGUAAUAGUUAUCACCU | 2733 | AGGUGAUAACUAUUACCGU | 2734 |
| 2506 | AAUAGUUAUCACCUUCUAA | 2735 | UUAGAAGGUGAUAACUAUU | 2736 |
| 2507 | AUAGUUAUCACCUUCUAAA | 2737 | UUUAGAAGGUGAUAACUAU | 2738 |
| 2521 | CUAAAUUACUAUGUAAUUU | 2739 | AAAUUACAUAGUAAUUUAG | 2740 |
| 2543 | CACUUAUUAUGUUUAUUGU | 2741 | ACAAUAAACAUAAUAAGUG | 2742 |
| 2555 | UUAUUGUCUUGUAUCCUUU | 2743 | AAAGGAUACAAGACAAUAA | 2744 |
| 2564 | UGUAUCCUUUCUCUGGAGU | 2745 | ACUCCAGAGAAAGGAUACA | 2746 |
| 2566 | UAUCCUUUCUCUGGAGUGU | 2747 | ACACUCCAGAGAAAGGAUA | 2748 |
| 2571 | UUUCUCUGGAGUGUAAGCA | 2749 | UGCUUACACUCCAGAGAAA | 2750 |
| 2574 | CUCUGGAGUGUAAGCACAA | 2751 | UUGUGCUUACACUCCAGAG | 2752 |
| 2575 | UCUGGAGUGUAAGCACAAU | 2753 | AUUGUGCUUACACUCCAGA | 2754 |
| 2580 | AGUGUAAGCACAAUGAAGA | 2755 | UCUUCAUUGUGCUUACACU | 2756 |
| 2586 | AGCACAAUGAAGACAGGAA | 2757 | UUCCUGUCUUCAUUGUGCU | 2758 |
| 2588 | CACAAUGAAGACAGGAAUU | 2759 | AAUUCCUGUCUUCAUUGUG | 2760 |
| 2589 | ACAAUGAAGACAGGAAUUU | 2761 | AAAUUCCUGUCUUCAUUGU | 2762 |
| 2594 | GAAGACAGGAAUUUUGUAU | 2763 | AUACAAAAUUCCUGUCUUC | 2764 |
| 2613 | AUUUUUAACCAAUGCAACA | 2765 | UGUUGCAUUGGUUAAAAAU | 2766 |
| 2619 | AACCAAUGCAACAUACUCU | 2767 | AGAGUAUGUUGCAUUGGUU | 2768 |
| 2624 | AUGCAACAUACUCUCAGCA | 2769 | UGCUGAGAGUAUGUUGCAU | 2770 |
| 2627 | CAACAUACUCUCAGCACCU | 2771 | AGGUGCUGAGAGUAUGUUG | 2772 |
| 2628 | AACAUACUCUCAGCACCUA | 2773 | UAGGUGCUGAGAGUAUGUU | 2774 |
| 2629 | ACAUACUCUCAGCACCUAA | 2775 | UUAGGUGCUGAGAGUAUGU | 2776 |
| 2630 | CAUACUCUCAGCACCUAAA | 2777 | UUUAGGUGCUGAGAGUAUG | 2778 |
| 2646 | AAAUAGUGCCGGGAACAU | 2779 | AUGUUCCCGGCACUAUUUU | 2780 |
| 2649 | AUAGUGCCGGGAACAUAGU | 2781 | ACUAUGUUCCCGGCACUAU | 2782 |
| 2656 | CGGGAACAUAGUAAGGGCU | 2783 | AGCCCUUACUAUGUUCCCG | 2784 |
| 2660 | AACAUAGUAAGGGCUCAGU | 2785 | ACUGAGCCCUUACUAUGUU | 2786 |
| 2667 | UAAGGGCUCAGUAAAUACU | 2787 | AGUAUUUACUGAGCCCUUA | 2788 |
| 2668 | AAGGGCUCAGUAAAUACUU | 2789 | AAGUAUUUACUGAGCCCUU | 2790 |
| 2682 | UACUUGUUGAAUAAACUCA | 2791 | UGAGUUUAUUCAACAAGUA | 2792 |
| 2684 | CUUGUUGAAUAAACUCAGU | 2793 | ACUGAGUUUAUUCAACAAG | 2794 |
| 2698 | UCAGUCUCCUACAUUAGCA | 2795 | UGCUAAUGUAGGAGACUGA | 2796 |
| 2700 | AGUCUCCUACAUUAGCAUU | 2797 | AAUGCUAAUGUAGGAGACU | 2798 |
| 2702 | UCUCCUACAUUAGCAUUCU | 2799 | AGAAUGCUAAUGUAGGAGA | 2800 |
| 2703 | CUCCUACAUUAGCAUUCUA | 2801 | UAGAAUGCUAAUGUAGGAG | 2802 |
| 2704 | UCCUACAUUAGCAUUCUAA | 2803 | UUAGAAUGCUAAUGUAGGA | 2804 |

Example 8. In Vivo Dose Response of EGLN Cocktail in Liver

Figure 11:
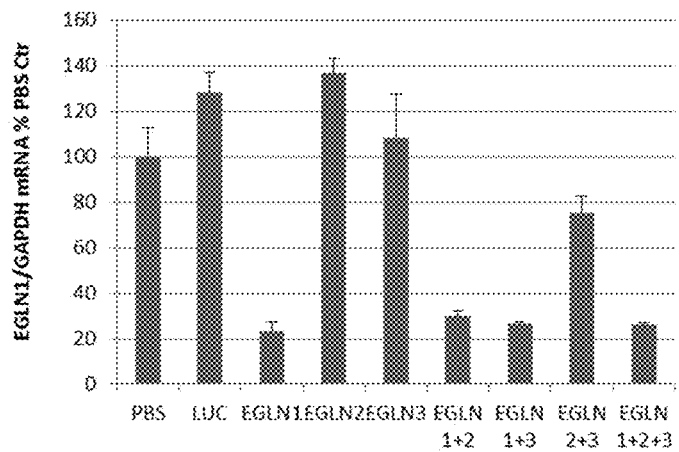
FIG. 11 is a histogram showing the specificity of knockdown of EGLN genes by the iRNA agents of the invention in a dose response study (mg per kg). Panel 1 shows the specificity of the EGLN1 iRNA agent, AD-40894 for EGLN1. Panel 2 shows the specificity of the EGLN2 iRNA agent, AD-40773 for EGLN2. Panel 3 shows the specificity of the EGLN3 iRNA agent, AD-40758 for EGLN3. Each panel also shows the knockdown of the respective EGLN gene using single iRNA agent mixes (AD-40894 is "EGLN1," AD-40773 is "EGLN2" and AD-40758 is "EGLN3"), dual iRNA agent mixes (AD-40894 and AD-40773 is "EGLN 1+2," AD-04894 and AD-40758 is "EGLN 1+3," AD-40773 and AD-40758 is "EGLN 2+3")
Figure 11:
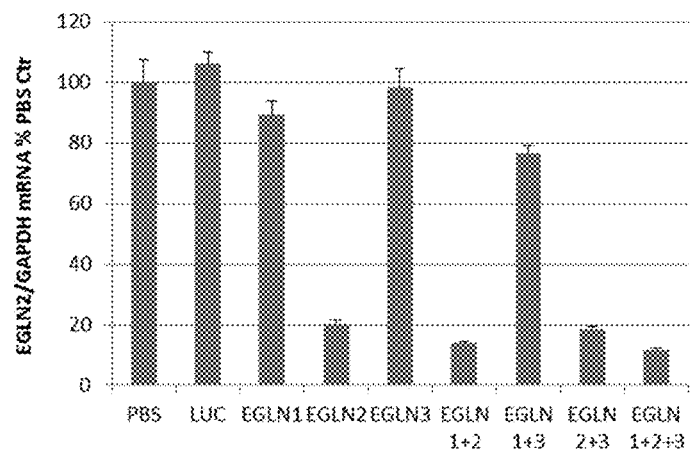
Figure 11:
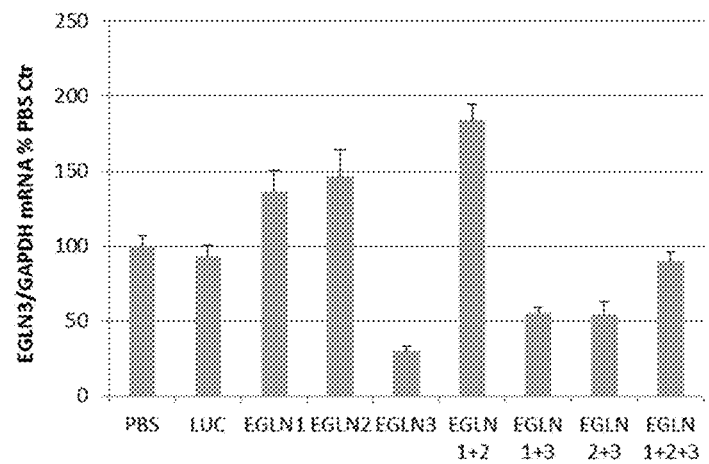

In order to evaluate the efficacy of the iRNA agents directed to EGLN genes, dose response studies were conducted targeting individual EGLN genes and combinations of EGLN genes in the liver. For these studies, mice (3 animals per group) were injected IV with formulations at the doses outlined in Table 7. A mix of EGLN1 and EGLN3, EGLN1 and EGLN2, EGLN2 and EGLN3 and EGLN1, EGLN2 and EGLN3 formulations were tested to confirm if co-injection of individual LNP11 formulations with siRNA against single targets worked as well as injection of a single formulation with siRNAs against all 3 EGLN targets. At 6 days after the second dose the animals were sacrificed and the livers were evaluated for bDNA. Serum was evaluated for EPO measurements by ELISA. The results are shown in FIG. 11.

It was found that each EGLN specific siRNA produced specific and robust knockdown in the liver. Furthermore, synergies were detected when the siRNA to more than one EGLN targeting siRNA was used.

TABLE 7

In vivo knockdown of EGLN genes

| Group | siRNA | Dose (mg/kg) |
|---|---|---|
| PBS | — | |
| Luciferase | AD-1955 | 0.5 |
| EGLN1 | AD-40894 | 0.5 |
| EGLN2 | AD-40773 | 0.5 |
| EGLN3 | AD-40758 | 0.5 |
| EGLN1 + 2 | AD-40894 (50%) AD-40773 (50%) | 0.5/0.5 |
| EGLN1 + 3 | AD-40894 (50%) AD-40758 (50%) | 0.5/0.5 |
| EGLN2 + 3 | AD-40773 (50%) AD-40758 (50%) | 0.5/0.5 |
| EGLN1 + 2 + 3 | AD-40894 (33%) AD-40773 (33%) AD-40758 (33%) | 0.5/0.5/0.5 |

Example 9. In Vivo Production of Erythropoietin and Hematology Using EGLN Cocktail In order to determine whether the administration of an EGLN iRNA cocktail was capable of increasing erythropoietin expression in vivo, a study was designed according to Table 8. Female C57B6 mice were dosed IV with PBS or LNP11-1955 luciferase controls, three different EGLN siRNA formulations or four different mixes of EGLN siRNA formulations. At day 6, a second dose was administered. On day 12, plasma samples were taken, animals were sacrificed and livers were harvested for measurement of EGLN1, EGLN2, EGLN3 and EPO mRNA. Also on day 12 blood was drawn (hematology measurements including a count of reticulocytes, red blood cells, hemoglobin measurements and hematocrit levels) and animals were sacrificed and the livers were taken for bDNA analysis. The data are shown in FIGS. 12 and 13.

TABLE 8

In vivo knockdown of EGLN genes

| Group | siRNA | Dose (mg/kg) |
|---|---|---|
| PBS | — | |
| Luciferase | AD-1955 | 0.5 |
| EGLN1 | AD-40894 | 0.5 |
| EGLN2 | AD-40773 | 0.5 |
| EGLN3 | AD-40758 | 0.5 |
| EGLN1 + 2 | AD-40894 (50%) AD-40773 (50%) | 0.5/0.5 |
| EGLN1 + 3 | AD-40894 (50%) AD-40758 (50%) | 0.5/0.5 |
| EGLN2 + 3 | AD-40773 (50%) AD-40758 (50%) | 0.5/0.5 |
| EGLN1 + 2 + 3 | AD-40894 (33%) AD-40773 (33%) AD-40758 (33%) | 0.5/0.5/0.5 |

It can be seen from FIGS. 12 and 13 that targeting EGLN1 alone or in combination with other EGLN genes increases serum EPO levels. It is suggested herein that knockdown of EGLN1 and/or EGLN2 induces feedback loop upregulation of EGLN3 mimicking hypoxic response.

In general, a considerable increase in reticulocytes versus control was observed with an even larger increase in hematocrit, RBC count and hemoglobin levels in the plasma. Therefore, it has been surprisingly discovered that knockdown of EGLN1 (either alone or in combination) which produced an increase in EPO, concomitantly stimulated erythropoiesis.

Example 10. Downregulation of Hepcidin

In order to evaluate the efficacy of the iRNA agents on the downregulation of Hepcidin dose response studies were conducted for iRNAs targeting individual EGLN genes and combinations of EGLNs in the liver. For these studies, mice (5 animals per group) were injected IV with formulations at the doses outlined in Table 9. Animals were dosed at day 1 and day 6. At day 12, the animals were bled and sacrificed and the livers were taken. The levels of hepcidin in liver were measured by bDNA. Downregulation of Hepcidin was observed when the formulations included at least EGLN1 (alone or in combination). The results are shown in FIG. 14.

TABLE 9

Downregulation of Hepcidin

| Group | siRNA | Dose (mg/kg) |
|---|---|---|
| PBS | — | |
| Luciferase | AD-1955 | 0.5 |
| EGLN1 | AD-40894 | 0.5 |
| EGLN2 | AD-40773 | 0.5 |
| EGLN3 | AD-40758 | 0.5 |
| EGLN1 + 2 | AD-40894 (50%) AD-40773 (50%) | 0.5/0.5 |
| EGLN1 + 3 | AD-40894 (50%) AD-40758 (50%) | 0.5/0.5 |
| EGLN2 + 3 | AD-40773 (50%) AD-40758 (50%) | 0.5/0.5 |
| EGLN1 + 2 + 3 | AD-40894 (33%) AD-40773 (33%) AD-40758 (33%) | 0.5/0.5/0.5 |

Example 11. Tissue Specificity

In order to determine whether administration of an EGLN iRNA cocktail was capable of tissue specificity, a study was designed according to Table 10. Female C57B6 mice were dosed four times, at day 1, 8, 15 and 22, by IV with LNP11-1955 luciferase control or a cocktail of EGLN siRNA formulation. On day 29, a set of plasma samples were taken, animals were sacrificed and livers, kidneys and spleens were harvested for measurement of EGLN1, EGLN2, EGLN3 and EPO mRNA measurements again by branched DNA analysis.

TABLE 10

Tissue specificity

| Group | siRNA | Dose (mg/kg) |
|---|---|---|
| Luciferase | AD-1955 | |
| EGLN mix | AD-40894 (.375 mg/kg) | 1.5 total |
| | AD-40773 (.75 mg/kg) | |
| | AD-40758 (.375 mg/kg) | |

It can be seen from FIG. 15 that the EGLN cocktail stimulated EPO in the liver and showed little to no stimulation in the kidneys and spleen. Hence the increase in serum EPO must arise from the liver. Liver tissue was removed and stained with oil red oil and H&E and compared to the positive control for fatty liver. Tissue staining revealed that weekly dosing (up to one month) was well tolerated by the liver.

Example 12. Durable Effects of Cocktail Administration

In order to determine durability of administration of an EGLN iRNA cocktail on the regulation of EPO and hematocrit, a study was designed according to Table 11. Female C57B6 mice were dosed IV with LNP11-1955 luciferase control or a formulation of a mix of EGLN siRNA as outlined in Table 11. Two groups of mice were dosed at either (1) only day 1 or (2) on days 1 and 6. At days 6, 11, 16, and 22 serum EPO was measured. At days 6, 11, 16, and 22, 27 and 33 hematocrit was measured. The results are shown in FIG. 16.

TABLE 11

Durable effects of cocktail administration on Epo and hematocrit

| Group | siRNA | Dose (mg/kg) |
|---|---|---|
| Luciferase | AD-1955 | 1.5 |
| EGLN mix (day 1 dose) | AD-40894 (.5 mg/kg) AD-40773 (.5 mg/kg) AD-40758 (.5 mg/kg) | 1.5 |
| EGLN mix (day 1 and 6 dose) | AD-40894 (.5 mg/kg) AD-40773 (.5 mg/kg) AD-40758 (.5 mg/kg) | 1.5 |

It can be seen from FIG. 16 that the knockdown by the EGLN mix was sustained over a prolonged period of time. The durability of a single dose could be seen in the samples taken for hematocrit showing lasting effects of over one month. Prolonged effects of the administration of the EGLN cocktail were also seen in the increased levels of EPO which lasted about 2 weeks after a single dose of the cocktail.

Example 13. Studies in an Animal Model of Anemia

Studies of the effects of the iRNA agents (alone or in combination) on a mouse model of anemia were performed to evaluate therapeutic outcomes and efficacy. Endpoints included target knockdown of each of the EGLN genes as well as hepcidin, improved EPO production, hematology measurements (including red blood cell count, Hemoglobin levels, hematocrit levels, and reticulocyte levels), and iron parameters (including serum iron level, transferrin saturation (% TSAT), unsaturated iron binding capacity (UIBC), total iron binding capacity (TIBC) and ferritin levels).

FBVN mice which had undergone 5/6 nephrectomy (Charles River Laboratories; Wilmington, Mass.) were dosed three times, at day 0, 4 and 8. Dosing involved IV administration at 1 mg/kg of the siRNA or siRNAs outlined in Table 12 formulated in LNP11. The study also included control groups of SHAM and PBS treated control groups as well as a control group containing the Luciferase siRNA AD-1955. At day 12 the animals were sacrificed, with terminal bleeds made and tissues removed for mRNA analysis. In all cases, the levels are normalized to levels of actin and presented as a percent sham. The results are presented in FIGS. 17-22 and discussed below.

TABLE 12

In vivo studies in a model of anemia

| Group | siRNA | Formulation | Sample Size (n) | Dose (mg/kg) |
|---|---|---|---|---|
| SHAM | — | | 5 | |
| PBS | — | | 5 | |
| Luciferase (control) | AD-1955 | LNP11 | 5 | 1 |
| EGLN1 | AD-40894 | LNP11 | 4 | 1 |
| EGLN1-2 | AD-40894 (50%) AD-40773 (50%) | LNP11 | 5 | 1 (0.5 ea) |
| EGLN1-2-3 mix | AD-40894 (33%) AD-40773 (33%) AD-40758 (33%) | LNP11 | 4 | 1 (0.33 ea) |

Target mRNA Knockdown (EGLN and Hepcidin)

Results of measurement of EGLN 1, 2, and 3 in liver as well as hepcidin expression is shown in FIGS. 17 and 18, respectively. It can be seen from the data that, just as with previous studies, the effects of the iRNA agents targeting the EGLN genes, either alone or in combination are specific and robust. There was upregulation of EGLN3 mRNA seen previously due to feedback regulation particularly in EGLN1-2 treated groups.

Downregulation of hepcidin (HAMP1) was observed when the formulations included at least EGLN1 (alone or in combination). Clearly, knockdown of EGLN1, EGLN1-2 and EGLN1-2-3 was shown to induce a down regulation of Hepcidin mRNA in the liver.

Improved EPO Production

Measurements of erythropoietin were made at the terminal bleed at day 12 and the data are shown in FIG. 19. It can be seen that knockdown of EGLN1-2 and EGLN1-2-3 significantly increased liver EPO mRNA in the context of 5/6 nephrectomy. An increase in EPO mRNA was not detected with EGLN1 knockdown consistent with previous experiments where the increase was only seen at the protein level. These results suggest that in anemic patients, administration of the iRNA agents targeting EGLN genes may serve a therapeutic need to increase EPO.

Hematology

Hematocrit levels of the test groups were measured at day 0 and at sacrifice on day 12. The pre and post values of the animals are shown in FIG. 20. As can be seen from the data, there was a significant increase in Hematocrit in double and triple combo groups with a more minor effect seen in EGLN1 alone treated animals compared to SHAM controls.

Measurements of red blood cell count, Hemoglobin, and reticulocyte levels were also made at day 12 and good increases in hemoglobin and reticulocytes in all EGLN groups was observed. See FIG. 21.

Iron Parameters

Parameters associated with the etiology of anemia and erythropoiesis were also measured at day 12. These data are presented in FIG. 22. Decreases seen in TSAT, and increases in UIBC and TIBC in the double and triple combo EGLN knockdown animals was very informative. These data suggest that there might not be sufficient iron available to meet the enhanced erythropoiesis demand (due to stimulation by the iRNA agents administered) of the system. In other words, the effect of the iRNA agents in enhancing erythropoiesis was so successful, it outpaced (or drained) the iron pool of the animal. These data suggest that the iRNA agents may be even more effective if administered in conjunction with an iron supplement.

Example 14. Design and Synthesis of siRNA Targeting Human EGLN Genes

Oligonucleotide design was carried out to identify siRNAs targeting the genes encoding the human (*Homo sapiens*) EGLN 1, 2 and 3 genes. The design process used the EGLN transcript NM_022051.2 for EGLN1 (SEQ ID NO: 390), NM_053046.2 for EGLN2 (SEQ ID NO: 391), and NM_022073.3 for EGLN3 (SEQ ID NO: 392). All sequences were obtained from the NCBI Refseq collection. All siRNA duplexes were designed that shared 100% identity with the listed human and rhesus transcripts. The constructs are shown in Tables 13A, B and C.

TABLE 13A

Human EGNL1 Single Strands and Duplex Sequences
For all the sequences in the list, 'endolight' chemistry was applied as described above.

| Duplex Number | Sequence (5' to 3') Sense | SEQ ID NO | Sequence (5' to 3') Antisense | SEQ ID NO |
|---|---|---|---|---|
| AD-47677.1 | cAcGAcAccGGGAAGuucAdTsdT | 2807 | UGAACUUCCCGGUGUCGUGdTsdT | 2808 |
| AD-47683.1 | GAcuGGGAuGccAAGGuAAdTsdT | 2809 | UuACCUUGGcAUCCcAGUCdTsdT | 2810 |
| AD-47688.1 | ccAAGGuAAGuGGAGGuAudTsdT | 2811 | AuACCUCcACUuACCUUGGdTsdT | 2812 |
| AD-47694.1 | GuGGAGGuAuAcuucGAAudTsdT | 2813 | AUUCGAAGuAuACCUCcACdTsdT | 2814 |
| AD-47694.2 | GuGGAGGuAuAcuucGAAudTsdT | 2815 | AUUCGAAGuAuACCUCcACdTsdT | 2816 |
| AD-47700.1 | GAGGuAuAcuucGAAuuuudTsdT | 2817 | AAAAUUCGAAGuAuACCUCdTsdT | 2818 |
| AD-47706.1 | ccAAAuuuGAuAGAcuGcudTsdT | 2819 | AGcAGUCuAUcAAAUUUGGdTsdT | 2820 |
| AD-47711.1 | GcuAcAAGGuAcGcAAuAAdTsdT | 2821 | UuAUUGCGuACCUUGuAGCdTsdT | 2822 |
| AD-47716.1 | GAGAGcAcGAGcuAAAGuAdTsdT | 2823 | uACUUuAGCUCGUGCUCUCdTsdT | 2824 |
| AD-47678.1 | GAGcuAAAGuAAAAuAucudTsdT | 2825 | AGAuAUUUuACUUuAGCUCdTsdT | 2826 |
| AD-47689.1 | GuGuGAGGGuuGAAcucAAdTsdT | 2827 | UUGAGUUcAACCCUcAcACdTsdT | 2828 |
| AD-47695.1 | GuGAGGGuuGAAcucAAuAdTsdT | 2829 | uAUUGAGUUcAACCCUcACdTsdT | 2830 |
| AD-47701.1 | GGuuGAAcucAAuAAAccudTsdT | 2831 | AGGUUuAUUGAGUUcAACCdTsdT | 2832 |
| AD-47707.1 | GAcGucuucuAGAGccuuudTsdT | 2833 | AAAGGCUCuAGAAGACGUCdTsdT | 2834 |
| AD-47712.1 | ccAGAucuGuuAucuAGcudTsdT | 2835 | AGCuAGAuAAcAGAUCUGGdTsdT | 2836 |
| AD-47717.1 | GuuAucuAGcuGAGuucAudTsdT | 2837 | AUGAACUcAGCuAGAuAACdTsdT | 2838 |
| AD-47679.1 | GGuAcAAuuuAucuAAAcudTsdT | 2839 | AGUUuAGAuAAAUUGuACCdTsdT | 2840 |

TABLE 13A-continued

Human EGNL1 Single Strands and Duplex Sequences
For all the sequences in the list, 'endolight' chemistry was
applied as described above.

| Duplex Number | Sequence (5' to 3') Sense | SEQ ID NO | Sequence (5' to 3') Antisense | SEQ ID NO |
|---|---|---|---|---|
| AD-47684.1 | ccucuuAAuAAuGAuuGuudTsdT | 2841 | AAcAAUcAUuAUuAAGAGGdTsdT | 2842 |
| AD-47690.1 | GccAGuGAcuGAuGAuuAAdTsdT | 2843 | UuAAUcAUcAGUcACUGGCdTsdT | 2844 |
| AD-47696.1 | ccAGuGAcuGAuGAuuAAudTsdT | 2845 | AUuAAUcAUcAGUcACUGGdTsdT | 2846 |
| AD-47702.1 | GAGcAcuuuAAuuAcAAcudTsdT | 2847 | AGUUGuAAUuAAAGUGCUCdTsdT | 2848 |
| AD-47708.1 | ccAuuuAcuAccAAuAAcudTsdT | 2849 | AGUuAUUGGuAGuAAAUGGdTsdT | 2850 |
| AD-47713.1 | GGcuGGGGuuuAAGuuAAAdTsdT | 2851 | UUuAACUuAAACCCcAGCCdTsdT | 2852 |
| AD-47718.1 | GcuGGGGuuuAAGuuAAAudTsdT | 2853 | AUUuAACUuAAACCCcAGCdTsdT | 2854 |
| AD-47680.1 | cuucAAGuuccuAAGAuAAdTsdT | 2855 | UuAUCUuAGGAACUUGAAGdTsdT | 2856 |
| AD-47685.1 | GGGcuuucuuAAGcuuucAdTsdT | 2857 | UGAAAGCUuAAGAAAGCCCdTsdT | 2858 |
| AD-47691.1 | cuuAGAcuucAcuuuccuAdTsdT | 2859 | uAGGAAAGUGAAGUCuAAGdTsdT | 2860 |
| AD-47697.1 | cuucAcuuuccuAGGcuuudTsdT | 2861 | AAAGCCuAGGAAAGUGAAGdTsdT | 2862 |
| AD-47703.1 | cuAucucuGuccuuGAucudTsdT | 2863 | AGAUcAAGGAcAGAGAuAGdTsdT | 2864 |
| AD-47709.1 | GccAAAAuGuGAGuAuAcAdTsdT | 2865 | UGuAuACUcAcAUUUUGGCdTsdT | 2866 |
| AD-47714.1 | cAAAAuGuGAGuAuAcAGAdTsdT | 2867 | UCUGuAuACUcAcAUUUUGdTsdT | 2868 |
| AD-47719.1 | cuuAGGAGAAuuuGcAGGAdTsdT | 2869 | UCCUGcAAAUUCUCCuAAGdTsdT | 2870 |
| AD-47686.1 | GcGuuAGGccAcAAcucAAdTsdT | 2871 | UUGAGUUGUGGCCuAACGCdTsdT | 2872 |
| AD-47692.1 | cGuuAGGccAcAAcucAAAdTsdT | 2873 | UUUGAGUUGUGGCCuAACGdTsdT | 2874 |
| AD-47698.1 | cuAucuGuGGGuuGuGcuudTsdT | 2875 | AAGcAcAACCcAcAGAuAGdTsdT | 2876 |
| AD-47704.1 | cAGAcAGGucuuAAAuuGudTsdT | 2877 | AcAAUUuAAGACCUGUCUGdTsdT | 2878 |
| AD-47710.1 | GGAAAAGuuuAuAuAcucudTsdT | 2879 | AGAGuAuAuAAACUUUUCCdTsdT | 2880 |
| AD-47715.1 | cuGuuuGuGGccuAuAuGudTsdT | 2881 | AcAuAuAGGCcAcAAAcAGdTsdT | 2882 |
| AD-47720.1 | GuuuGuGGccuAuAuGuGudTsdT | 2883 | AcAcAuAuAGGCcAcAAACdTsdT | 2884 |
| AD-47682.1 | GuGuuuAAuccuGGuuAAAdTsdT | 2885 | UUuAACcAGGAUuAAAcACdTsdT | 2886 |
| AD-47687.1 | GuuuAAuccuGGuuAAAGAdTsdT | 2887 | UCUUuAACcAGGAUuAAACdTsdT | 2888 |

TABLE 13A-continued

Human EGNL1 Single Strands and Duplex Sequences
For all the sequences in the list, 'endolight' chemistry was
applied as described above.

| Duplex Number | Sequence (5' to 3') Sense | SEQ ID NO | Sequence (5' to 3') Antisense | SEQ ID NO |
|---|---|---|---|---|
| AD-47693.1 | cuGuuuuuAuucAAcAcAudTsdT | 2889 | AUGUGUUGAAuAAAAAcAGdTsdT | 2890 |
| AD-47699.1 | cAuAuAcAGAuAGAcuAuAdTsdT | 2891 | uAuAGUCuAUCUGuAuAUGdTsdT | 2892 |
| AD-47705.1 | cAAGuuGcuuGuAAAGcuAdTsdT | 2893 | uAGCUUuAcAAGcAACUUGdTsdT | 2894 |
| AD-40932.2 | GcuuGuAAAGcuAAucuAAdTsdT | 2895 | UuAGAUuAGCUUuAcAAGCdTsdT | 2896 |
| AD-40932.1 | GcuuGuAAAGcuAAucuAAdTsdT | 2897 | UuAGAUuAGCUUuAcAAGCdTsdT | 2898 |
| AD-40932.3 | GcuuGuAAAGcuAAucuAAdTsdT | 2899 | UuAGAUuAGCUUuAcAAGCdTsdT | 2900 |

TABLE 13B

Human EGNL2 Single Strands and Duplex Sequences
For all the sequences in the list, 'endolight' chemistry was
applied as described above.

| Duplex Number | Sequence (5' to 3') Sense | SEQ ID NO | Sequence (5' to 3') Antisense | SEQ ID NO |
|---|---|---|---|---|
| AD-47721.1 | cuucccAAGcccuuAGGGAdTsdT | 2901 | UCCCuAAGGGCUUGGGAAGdTsdT | 2902 |
| AD-47727.1 | cuuGGGGAccAGcAAGcAAdTsdT | 2903 | UUGCUUGCUGGUCCCcAAGdTsdT | 2904 |
| AD-47733.1 | cAuGcccGGGGGAuGAAGAdTsdT | 2905 | UCUUcAUCCCCCGGGcAUGdTsdT | 2906 |
| AD-47738.1 | cccGGGGGAuGAAGAcAcudTsdT | 2907 | AGUGUCUUcAUCCCCCGGGdTsdT | 2908 |
| AD-47744.1 | GGGGGAuGAAGAcAcuGcudTsdT | 2909 | AGcAGUGUCUUcAUCCCCCdTsdT | 2910 |
| AD-47750.1 | GcAGccccuAAGucAGGcudTsdT | 2911 | AGCCUGACUuAGGGGCUGCdTsdT | 2912 |
| AD-47756.1 | cAGuuAccAGGGucuucGudTsdT | 2913 | ACGAAGACCCUGGuAACUGdTsdT | 2914 |
| AD-47722.1 | GAGGccccAAAcGGAAAudTsdT | 2915 | AUUUCCGUUUGGGGGCCUCdTsdT | 2916 |
| AD-47728.1 | GGGccAGGcAAGAGAAccAdTsdT | 2917 | UGGUUCUCUUGCCUGGCCCdTsdT | 2918 |
| AD-47734.1 | GccuGcccuGGAcuAuAudTsdT | 2919 | AuAuAGUCcAGGGCcAGGCdTsdT | 2920 |
| AD-47739.1 | GcAuGcGGuAcuAcGGcAudTsdT | 2921 | AUGCCGuAGuACCGcAUGCdTsdT | 2922 |
| AD-47745.1 | GGuAcuAcGGcAucuGcGudTsdT | 2923 | ACGcAGAUGCCGuAGuACCdTsdT | 2924 |
| AD-47751.1 | cAuccGuGGGGAccAGAuudTsdT | 2925 | AAUCUGGUCCCcACGGAUGdTsdT | 2926 |

TABLE 13B-continued

Human EGNL2 Single Strands and Duplex Sequences
For all the sequences in the list, 'endolight' chemistry was
applied as described above.

| Duplex Number | Sequence (5' to 3') Sense | SEQ ID NO | Sequence (5' to 3') Antisense | SEQ ID NO |
|---|---|---|---|---|
| AD-47763.1 | cGGGuAcGuAAGGcAcGuudTsdT | 2927 | AACGUGCCUuACGuACCCGdTsdT | 2928 |
| AD-47723.1 | GGuAcGuAAGGcAcGuuGAdTsdT | 2929 | UcAACGUGCCUuACGuACCdTsdT | 2930 |
| AD-47729.1 | cGcuGcAucAccuGuAucudTsdT | 2931 | AGAuAcAGGUGAUGcAGCGdTsdT | 2932 |
| AD-40743.2 | GcAucAccuGuAucuAuuAdTsdT | 2933 | uAAuAGAuAcAGGUGAUGCdTsdT | 2934 |
| AD-40743.1 | GcAucAccuGuAucuAuuAdTsdT | 2935 | uAAuAGAuAcAGGUGAUGCdTsdT | 2936 |
| AD-47740.1 | ccuGuAucuAuuAccuGAAdTsdT | 2937 | UUcAGGuAAuAGAuAcAGGdTsdT | 2938 |
| AD-47746.1 | GuAucuAuuAccuGAAucAdTsdT | 2939 | UGAUUcAGGuAAuAGAuACdTsdT | 2940 |
| AD-47752.1 | GAAucAGAAcuGGGAcGuudTsdT | 2941 | AACGUCCcAGUUCUGAUUCdTsdT | 2942 |
| AD-47758.1 | cuGGGAcGuuAAGGuGcAudTsdT | 2943 | AUGcACCUuAACGUCCcAGdTsdT | 2944 |
| AD-47764.1 | cucuuuGAccGGuuGcucAdTsdT | 2945 | UGAGcAACCGGUcAAAGAGdTsdT | 2946 |
| AD-47724.1 | cuuuGAccGGuuGcucAuudTsdT | 2947 | AAUGAGcAACCGGUcAAAGdTsdT | 2948 |
| AD-47730.1 | GAccGGuuGcucAuuuucudTsdT | 2949 | AGAAAAUGAGcAACCGGUCdTsdT | 2950 |
| AD-47735.1 | GuGAAGccAGccuAuGccAdTsdT | 2951 | UGGcAuAGGCUGGCUUcACdTsdT | 2952 |
| AD-47741.1 | ccAGGuAcGccAucAcuGudTsdT | 2953 | AcAGUGAUGGCGuACCUGGdTsdT | 2954 |
| AD-47747.1 | ccAucAcuGucuGGuAuuudTsdT | 2955 | AAAuACcAGAcAGUGAUGGdTsdT | 2956 |
| AD-47753.1 | GcAGcAGccAAAGAcAAGudTsdT | 2957 | ACUUGUCUUUGGCUGCUGCdTsdT | 2958 |
| AD-47759.1 | cAGccAAAGAcAAGuAucAdTsdT | 2959 | UGAuACUUGUCUUUGGCUGdTsdT | 2960 |
| AD-47759.2 | cAGccAAAGAcAAGuAucAdTsdT | 2961 | UGAuACUUGUCUUUGGCUGdTsdT | 2962 |
| AD-47765.1 | cAAAGAcAAGuAucAGcuAdTsdT | 2963 | uAGCUGAuACUUGUCUUUGdTsdT | 2964 |
| AD-47725.1 | GAcAAGuAucAGcuAGcAudTsdT | 2965 | AUGCuAGCUGAuACUUGUCdTsdT | 2966 |
| AD-47731.1 | GuAucAGcuAGcAucAGGAdTsdT | 2967 | UCCUGAUGCuAGCUGAuACdTsdT | 2968 |
| AD-47736.1 | cAGcuAGcAucAGGAcAGAdTsdT | 2969 | UCUGUCCUGAUGCuAGCUGdTsdT | 2970 |
| AD-47742.1 | GcuAGcAucAGGAcAGAAAdTsdT | 2971 | UUUCUGUCCUGAUGCuAGCdTsdT | 2972 |
| AD-47748.1 | GAAAGGuGuccAAGuAccudTsdT | 2973 | AGGuACUUGGAcACCUUUCdTsdT | 2974 |

TABLE 13B-continued

Human EGNL2 Single Strands and Duplex Sequences
For all the sequences in the list, 'endolight' chemistry was
applied as described above.

| Duplex Number | Sequence (5' to 3') Sense | SEQ ID NO | Sequence (5' to 3') Antisense | SEQ ID NO |
|---|---|---|---|---|
| AD-47754.1 | ccuAGuGGccAGucccAGAdTsdT | 2975 | UCUGGGACUGGCcACuAGGdTsdT | 2976 |
| AD-47760.1 | cuGucuGGucAuGAccccAdTsdT | 2977 | UGGGGUcAUGACcAGAcAGdTsdT | 2978 |
| AD-47766.1 | GucuGGucAuGAccccAuudTsdT | 2979 | AAUGGGGUcAUGACcAGACdTsdT | 2980 |
| AD-47726.1 | cuGGGAGGAGGcAuuGucAdTsdT | 2981 | UGAcAAUGCCUCCUCCcAGdTsdT | 2982 |
| AD-47732.1 | GGAGGAGGcAuuGucAcuudTsdT | 2983 | AAGUGAcAAUGCCUCCUCCdTsdT | 2984 |
| AD-47737.1 | GcAuuGucAcuucccAccAdTsdT | 2985 | UGGUGGGAAGUGAcAAUGCdTsdT | 2986 |
| AD-47743.1 | GGAcuuGGGGuuGAGGuGAdTsdT | 2987 | UcACCUcAACCCcAAGUCCdTsdT | 2988 |
| AD-47749.1 | cucuuGcuGGcAAuGGGGudTsdT | 2989 | ACCCcAUUGCcAGcAAGAGdTsdT | 2990 |
| AD-47755.1 | ccAGccuGGAAuGuGAAGudTsdT | 2991 | ACUUcAcAUUCcAGGCUGGdTsdT | 2992 |
| AD-47761.1 | GGcAGAGuAAAAGGuGccAdTsdT | 2993 | UGGcACCUUUuACUCUGCCdTsdT | 2994 |

TABLE 13C

Human EGNL3 Single Strands and Duplex Sequences
For all the sequences in the list, 'endolight' chemistry was
applied as described above.

| Duplex Number | Sequence (5' to 3') Sense | SEQ ID NO | Sequence (5' to 3') Antisense | SEQ ID NO |
|---|---|---|---|---|
| AD-47767.1 | GuGGcAGccGcAGGuuucudTsdT | 2995 | AGAAACCUGCGGCUGCcACdTsdT | 2996 |
| AD-47773.1 | GcAGccGcAGGuuucuGAAdTsdT | 2997 | UUcAGAAACCUGCGGCUGCdTsdT | 2998 |
| AD-47779.1 | GGcuucGcGcucGuGuAGAdTsdT | 2999 | UCuAcACGAGCGCGAAGCCdTsdT | 3000 |
| AD-47785.1 | GcuucGcGcucGuGuAGAudTsdT | 3001 | AUCuAcACGAGCGCGAAGCdTsdT | 3002 |
| AD-47791.1 | cGcGcucGuGuAGAucGuudTsdT | 3003 | AACGAUCuAcACGAGCGCGdTsdT | 3004 |
| AD-47797.1 | GAucccGGAccucGAuucudTsdT | 3005 | AGAAUCGAGGUCCGGGAUCdTsdT | 3006 |
| AD-47803.1 | cAAGGAGAGGucuAAGGcAdTsdT | 3007 | UGCCUuAGACCUCUCCUUGdTsdT | 3008 |
| AD-47809.1 | GGcAAuGGuGGcuuGcuAudTsdT | 3009 | AuAGcAAGCcACcAUUGCCdTsdT | 3010 |
| AD-47768.1 | ccGGGAAuGGAAcAGGuudTsdT | 3011 | AACCUGUUCcAUUUCCCGGdTsdT | 3012 |
| AD-47786.1 | ccuGcAucuAcuAucuGAAdTsdT | 3013 | UUcAGAuAGuAGAUGcAGGdTsdT | 3014 |

TABLE 13C-continued

Human EGNL3 Single Strands and Duplex Sequences
For all the sequences in the list, 'endolight' chemistry was
applied as described above.

| Duplex Number | Sequence (5' to 3') Sense | SEQ ID NO | Sequence (5' to 3') Antisense | SEQ ID NO |
|---|---|---|---|---|
| AD-47792.1 | GAuccuGcGGAuAuuuccAdTsdT | 3015 | UGGAAAuAUCCGcAGGAUCdTsdT | 3016 |
| AD-47798.1 | GGGGAAAucAuucAuAGcAdTsdT | 3017 | UGCuAUGAAUGAUUUCCCCdTsdT | 3018 |
| AD-47804.1 | GGAAAucAuucAuAGcAGAdTsdT | 3019 | UCUGCuAUGAAUGAUUUCCdTsdT | 3020 |
| AD-47769.1 | GAcAGAcuccuGuucuucudTsdT | 3021 | AGAAGAAcAGGAGUCUGUCdTsdT | 3022 |
| AD-47775.1 | ccuGuucuucuGGucAGAudTsdT | 3023 | AUCUGACcAGAAGAAcAGGdTsdT | 3024 |
| AD-47781.1 | GcAAccAGAuAuGcuAuGAdTsdT | 3025 | UcAuAGcAuAUCUGGuUGCdTsdT | 3026 |
| AD-47787.1 | ccAGAuAuGcuAuGAcuGudTsdT | 3027 | AcAGUcAuAGcAuAUCUGGdTsdT | 3028 |
| AD-47793.1 | cuAuGAcuGucuGGuAcuudTsdT | 3029 | AAGuACcAGAcAGUcAuAGdTsdT | 3030 |
| AD-47805.1 | GAAAuucAGGAAuuuAAcudTsdT | 3031 | AGUuAAAUUCCUGAAUUUCdTsdT | 3032 |
| AD-47811.1 | GAAuuuAAcuAGGAAAAcudTsdT | 3033 | AGUUUUCCuAGUuAAAUUCdTsdT | 3034 |
| AD-47770.1 | GccuuGuucAuuuuAGuAAdTsdT | 3035 | UuACuAAAAUGAAcAAGGCdTsdT | 3036 |
| AD-47776.1 | GuuccuGAAuucucuuAAAdTsdT | 3037 | UUuAAGAGAAUUcAGGAACdTsdT | 3038 |
| AD-47776.2 | GuuccuGAAuucucuuAAAdTsdT | 3039 | UUuAAGAGAAUUcAGGAACdTsdT | 3040 |
| AD-47782.1 | cuGAAuucucuuAAAuucudTsdT | 3041 | AGAAUUuAAGAGAAUUcAGdTsdT | 3042 |
| AD-47788.1 | cAAAGAuGGccucuucAGudTsdT | 3043 | ACUGAAGAGGCcAUCUUUGdTsdT | 3044 |
| AD-47800.1 | cuGcuAcuucuuGcAuccudTsdT | 3045 | AGGAUGcAAGAAGuAGcAGdTsdT | 3046 |
| AD-47806.1 | cccuGucuuGuGuGGuAdTsdT | 3047 | uACcAcAcAcAAGAcAGGGdTsdT | 3048 |
| AD-47812.1 | cuuGuGuGGuAcuucAudTsdT | 3049 | AUGAAGuACcAcAcAcAAGdTsdT | 3050 |
| AD-47771.1 | GuGuGGuAcuucAuGuuuudTsdT | 3051 | AAAAcAUGAAGuACcAcACdTsdT | 3052 |
| AD-47777.1 | GuuucuuGccAAGAcuGudTsdT | 3053 | AcAGUCUUGGcAAGAAAACdTsdT | 3054 |
| AD-47783.1 | cGAGGGAAuGAAccuuAcudTsdT | 3055 | AGuAAGGUUcAUUCCCUCGdTsdT | 3056 |
| AD-47789.1 | cuuAcuuGcAcuuuAuGuAdTsdT | 3057 | uAcAuAAAGUGcAAGuAAGdTsdT | 3058 |
| AD-47795.1 | cAcuuuAuGuAuAcuuccudTsdT | 3059 | AGGAAGuAuAcAuAAAGUGdTsdT | 3060 |
| AD-47801.1 | GuAuAcuuccuGAuuuGAAdTsdT | 3061 | UUcAAAUcAGGAAGuAuACdTsdT | 3062 |

TABLE 13C-continued

Human EGNL3 Single Strands and Duplex Sequences
For all the sequences in the list, 'endolight' chemistry was
applied as described above.

| Duplex Number | Sequence (5' to 3') Sense | SEQ ID NO | Sequence (5' to 3') Antisense | SEQ ID NO |
|---|---|---|---|---|
| AD-47807.1 | GGAGAAuuAucAcAAccuAdTsdT | 3063 | uAGGuUGUGAuAAUUCUCCdTsdT | 3064 |
| AD-47813.1 | ccuAAuGAcAuuAAuAccudTsdT | 3065 | AGGuAUuAAUGUcAUuAGGdTsdT | 3066 |
| AD-47772.1 | cccuGGuAGuuuuGuGuuAdTsdT | 3067 | uAAcAcAAAACuACcAGGGdTsdT | 3068 |
| AD-47778.1 | ccuGGuAGuuuuGuGuuAAdTsdT | 3069 | UuAAcAcAAAACuACcAGGdTsdT | 3070 |
| AD-47784.1 | GuGGAAAGAGcuAGGucuAdTsdT | 3071 | uAGACCuAGCUCUUUCcACdTsdT | 3072 |
| AD-47790.1 | cuAGGucuAcuGAuAuAcAdTsdT | 3073 | UGuAuAUcAGuAGACCuAGdTsdT | 3074 |
| AD-47796.1 | GucuAcuGAuAuAcAAuAAdTsdT | 3075 | UuAUUGuAuAUcAGuAGACdTsdT | 3076 |
| AD-47802.1 | cAuGuGuGcAucuuGAAcAdTsdT | 3077 | UGUUcAAGAUGcAcAcAUGdTsdT | 3078 |
| AD-47808.1 | GuGuGcAucuuGAAcAAuudTsdT | 3079 | AAUUGUUcAAGAUGcAcACdTsdT | 3080 |

Example 15. Studies of siRNA in an Animal Model: Hematology Measurements

Studies of the effects of siRNA agents in combination on a mouse model were performed to evaluate therapeutic outcomes and efficacy. Endpoints included hematology measurements (including red blood cell count, Hemoglobin levels, hematocrit levels, and reticulocyte levels).

Wild type C57BL/6 mice were dosed two times, at day 0 and 6. Dosing involved tail vein administration of an equal part mixture of the three siRNAs (AD-40894, AD-40773 and AD-40758) targeting EGLN1, EGLN2, and EGLN3 respectively. The study also included control groups of PBS treated control and a control group containing the luciferase siRNA AD-1955. The results are presented in Table 14.

Hematology

Hematocrit levels of the test group were measured at day 4 and 9. As can be seen from the data in Table 14, there was an increase in hematocrit in the mice treated with an equal part mixture of siRNAs as compared to the PBS and Luciferase controls. Measurements of red blood cell count, Hemoglobin, and reticulocyte levels were also made at day 4 and 9 and an increase in Hemoglobin and reticulocyte levels was observed. These data are also presented in Table 14. In the table "Hg" stands for Hemoglobin in g/dL, "HCT" stands for Hematocrit in %, "Ret" stands for Reticulocytes in %, and "RBC" stands for Red Blood Cells ($\times 10^6$ cells/uL).

TABLE 14

In vivo studies in an animal model

| | Day 4 Bleed | | | | Day 9 Bleed | | | |
|---|---|---|---|---|---|---|---|---|
| | Ret | RBC | Hg | HCT | Ret | RBC | Hg | HCT |
| PBS | 3.4 | 8.7 | 12.6 | 40.6 | 7.4 | 8.3 | 12.2 | 39.3 |
| Luciferase | 3.2 | 8.6 | 12.3 | 39.7 | 7.1 | 7.7 | 11.3 | 36.2 |
| EGLN 1, 2, 3 | 10.1 | 9.4 | 13.6 | 45.8 | 12.5 | 10.5 | 15.4 | 52.9 |

Additional Hematology Studies: Day 0 and Day 5 Dosing

Studies on the effects of the siRNA agents (alone or in combination) on a mouse model were performed to evaluate the effect of the siRNA agents on EPO production and erythropoiesis. Endpoints included hematology measurements (including red blood cell count, Hemoglobin levels, hematocrit levels, and reticulocyte levels). Wild type C57BL/6 mice were dosed two times, at day 0 and 5. Dosing involved tail vein administration at 0.5 mg/kg per EGLN family member, EGLN1 (AD-40894), EGLN2 (AD-40773), and EGLN3 (AD-40758). The study also included control groups of PBS treated mice and a group containing the luciferase siRNA AD-1955.

Hematology

Hematocrit levels of the test group were measured at sacrifice on day 11. The values are shown in Table 15 along with reticulocyte levels, hemoglobin levels and red blood cell count.

TABLE 15

In vivo studies in an animal model on day 11

|  | Reticulocyte | Red Blood Cell | Hemoglobin | Hematocrit |
|---|---|---|---|---|
| PBS | 3.7 | 8.5 | 12.8 | 40.5 |
| Luciferase | 2.9 | 8.7 | 12.9 | 41.7 |
| EGLN1 | 8.7 | 10.6 | 15.4 | 52.3 |
| EGLN2 | 3.8 | 8.7 | 12.4 | 40.1 |
| EGLN3 | 3.6 | 8.3 | 12.3 | 40.0 |
| EGLN1,2 | 10.6 | 11.5 | 16.5 | 56.2 |
| EGLN2,3 | 7.6 | 10.0 | 14.8 | 49.3 |
| EGLN1,3 | 4.6 | 8.0 | 12.0 | 39.1 |
| EGLN 1,2,3 | 12.2 | 11.9 | 16.9 | 58.5 |

Example 16. 5'RACE Assay

A 5'RACE assay was used in order to monitor the cleavage site of target mRNA. The 5'RACE analysis showed that the downregulation of EGLN mRNA in the liver was specifically due to siRNA-mediated mRNA cleavage. Table 16 lists the 5'RACE primers used in this analysis.

TABLE 16

5'RACE Primers

|  | Sequence 5' to 3' | SEQ ID NO. |
|---|---|---|
| Adaptor oligo | CGACTGGAGCACGAGGACACTGACATGG | 3081 |
| Nested Adaptor oligo | GGACACTGACATGGACTGAAGGAGTAG | 3082 |
| EGLN1 GSP | AGAGATGAAATGAACTCAGTTAGGTGACAGGTCTG | 3083 |
| EGLN1 PCR Round 1 | TTGTTTCGTGTCCAGATGGAAAAGCTACTCTCCTC | 3084 |
| EGLN1 PCR Round 2 | GGCTTGAGTTCAACCCTCACACCTTTCTCACCTG | 3085 |
| EGLN2 GSP | TATTTCTTGGCTGGCAGAACCTCCATAC | 3086 |
| EGLN2 PCR Round 1 | CAGACAGTGGCAGCCCAGTCCATACACTG | 3087 |
| EGLN2 PCR Round 2 | CAGCAGAGGTCTCTCCTTGTTGCTCCTCAGTG | 3088 |
| EGLN3 GSP | GATGTGGAAGAACTCCAATAGCTCTGAGGTC | 3089 |
| EGLN3 PCR Round 1 | CAGTGCTGAATTACCAGGAAGCTTTCTATCCTCTG | 3090 |
| EGLN3 PCR Round 2 | GCAAGAAAACATGAAGTACCACAAACAAG | 3091 |

Example 17. Animal Model: Anemia

We next asked if EGLN siRNA could be used to treat anemia in the setting of chronic renal failure. Toward this end mice were subjected to 5/6 nephrectomy, which is a widely used model for anemia linked to renal failure, or sham operations (FIG. 23). The mice undergoing nephrectomy developed anemia, as expected, and were then randomized to receive phosphate buffered saline (PBS), control siRNA (luciferase siRNA), siRNAs targeting EglN1, EGLN1 and EGLN2, or combinations thereof. In keeping with the data described above, inactivation of EGLN1 led to a modest increase in red blood cell production, which was markedly accentuated by coinactivation of EGLN2. Treatment with EGLN1 and EGLN2 constructs restored both hemoglobin and hematocrit levels (FIG. 23 B, C). The maximal erythropoietic response, however, was observed after treatment with siRNA targeting all 3 EGLN paralogs. EglN inactivation in this model also led to an upregulation of EPO and a decrease in hepcidin mRNA levels, consistent with earlier studies using chemical hydroxylase inhibitors (FIG. 24).

Chronic inflammation can lead to anemia due, at least partly, to increased levels of hepcidin and altered iron trafficking (anemia of chronic disease). Rats with experimental arthritis induced by a polymer of a streptococcal antigen (PG-APS) have been used as a model for the anemia linked to inflammation (M. A. Coccia et al., Exp Hematol 29, 1201 (October, 2001); R. B. Sartor et al., Infect Immun 57, 1177 (April, 1989); W. J. Cromartie, J. G. Craddock, J. H. Schwab, S. K. Anderle, C. H. Yang, J Exp Med 146, 1585 (Dec. 1, 1977). In the 5/6 nephrectomy model combined inactivation of EGLN1 and EGLN2 was sufficient to induce a brisk erythropoietic response (FIG. 23) and we were able to identify siRNAs that can effectively target rat EglN1 and EglN2 (FIG. 25A-C). Treatment of anemic PG-APS rats with mixtures of siRNAs targeting both EglN1 and EglN2 decreased their hepcidin levels and corrected their anemia (FIG. 25).

These studies suggest that systemically administered siRNAs targeting the EGLN family would ameliorate anemias characterized by an absolute or relative deficiency of erythropoietin, such as anemias linked to chronic kidney disease or inflammation, in man. This approach would allow the body to produce native erythropoietin, thereby obviating the need for recombinant versions of this hormone. Moreover other hepatic changes induced by EGLN inhibition, such as decreased production of hepcidin, might enhance the effectiveness of endogenous erythropoietin and thereby lower the circulating erythropoietin levels needed to promote red blood cell production. This might be desirable if some of the cardiovascular complications of chronic erythropoietin production are more tightly linked to circulating erythropoietin levels, especially when supraphysiological, than to red blood cell mass per se.

Example 18. Decrease of Hepatic EGLN Activity: Photon Emission Study

It has previously been shown that EGLN activity can be monitored non-invasively in mice that ubiquitously express a HIF1α-luciferase fusion protein that contains a region of HIF1α that is sufficient to be hydroxylated by EGLN and subsequently ubiquitinated by the pVHL ubiquitin ligase complex (M. Safran et al., *Proc Natl Acad Sci USA* 103, 105 (Jan. 3, 2006). As expected, administration of the EGLN siRNA mix to these mice decreased hepatic, but not renal, EGLN activity as determined by increased photon emission in the region of the liver, but not kidneys, following luciferin administration (See FIG. 26). Branched DNA analysis confirmed that EglN1, EglN2, and EglN3 mRNAs were decreased in the liver, but not the kidney, and was associated with an increase hepatic, but not renal, EPO mRNA production.

It is to be understood that the words which have been used are words of description rather than limitation, and that changes may be made within the purview of the appended claims without departing from the true scope and spirit of the invention in its broader aspects.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention.

All publications, patent applications, patents, and other references mentioned herein are incorporated by reference in their entirety. In case of conflict, the present specification, including definitions, will control. In addition, section headings, the materials, methods, and examples are illustrative only and not intended to be limiting.

SEQUENCE LISTING (3091 sequences)

SEQ ID NO: 1 - protein, 16 aa, Artificial Sequence
  Description of Artificial Sequence: Synthetic MTS-containing peptide
AAVALLPAVLLALLAP

SEQ ID NO: 2 - protein, 11 aa, Artificial Sequence
  Description of Artificial Sequence: Synthetic RFGF analogue sequence
AALLPVLLAAP

SEQ ID NO: 3 - protein, 13 aa, Human immunodeficiency virus
GRKKRRQRRRPPQ

SEQ ID NO: 4 - protein, 16 aa, Drosophila sp.
RQIKIWFQNRRMKWKK

SEQ ID NO: 5 - DNA, 3524 bp, Mus musculus
ggctgggcccgcccgcccagggcgctgtgcgccgcgcaggccgcgctctctccggcgcgatgcggcgctaggcggccccgggcaaggcaggcgaggccagggcgcgcgcggcctcccgcagcgggcggcggccccgggcgggcgccccgacggccccgccgccgccccgctcccggcccgcggcccgccctgccgcggccatggccagtgacagcggcgggcccggcgtgctgagcgccagcgagcgcgaccggcagtactgcgagctgtgcgggaagatggagaacctgctgcgctgcggccgctgccgcagctccttctactgctgcaaagagcaccagcgccaggactggaagaagcacaagctggtgtgccagggcggcgaggccccccgcgcgcagcccgcgccggcgcagccccgcgtcgcgcccccgcccggtggggcccccggagccgcgcgcgccggcggggcggcccggcgcggggacagcgcggcggcctcgcgcgtaccgggcccggaggacgcggcgcaggcccggagcggccccggcccagcagagcccggctccgaggatcctccgcttagccggtctccgggccccgagcgcgccagcctgtgcccagcgggtggcggccccggggaggcgctgagtcccggtggagggctgcggcccaacgggcagaccaagccgttgcccgcgttgaagctggctctggagtacatcgtgccgtgcatgaacaagcacggcatctgcgtggtggacgacttcctgggcagggagaccgggcagcagatcggcgatgaggtgcgcgccctgcacgacaccggcaagttcacggacgggcagctggtcagccagaagagtgactcttccaaggacatccggggggaccagatcacctggatcgagggcaaagagcccggctgcgaaaccatcggcctgctcatgagcagcatggacgacctgatccgccactgcagcgggaagctgggcaactacaggataaacggccgaacgaaagccatggttgcttgttacccaggcaacggaacaggctatgtccgtcacgttgataacccaaatggagatggaagatgcgtgacatgtatatattatctaaataaagactgggacgccaaggtaagtggaggtattcttcgaatttttccagaaggcaaagcccagtttgctgacattgaacccaaatttgatagactgctgtttttctggtctgaccggcgtaaccctcatgaagtacagccagcatacgccacaaggtacgcaataactgtttggtattttgatgcagatgagcgagcgagagctaaagtaaaatatctaacaggtgagaaaggtgtgagggttgaactcaagcccaattcagtcagcaaagacgtctagtggggccttgggtccggcagtacccacgtcacctacagcctctcagttgccttctgtggactcgtggacaggatggacagagagacacctgcctggtatttcagctgggagccaggcgacttcgccgggtgtcatccaacagagggctccatctgctgggactgtactgtggggtcagctccagatctgtgactgctcttggctgctgacccaagaggagacgctgtcggaggagagtagcttttccatctggacacgaaacaagggccctttgtaggaatttcttcagtcttctattttgccagacctgtcacctaactgagttcatttcatctcttttttatatcaagttttgaattcggggaatttttgtattaggtacaatttatcaaaactgaattaagaaaaaaaaatttacagtattattctcaaaataacatcaatctatttttgtaaacctcttcatgctattaaattttgccctcaaggcctcctgcgatgattgttgccagtgagtgacgacgtgttgcttctgcctgaacgtaaaggacgggcgggcgctgtgtcccagcccgagtgcacgaggtttttcttggcccgtctctcagtgattccaacctgtaaaggtcactgctctcgcgcttcgaccgacctaacagtagatggttgccactggcactcaactaactcaacatagttacaagaggaaacaagccacaggagagggtttgtctcttcagttaatttttttaaagcgaagtgacgggcactaaatgaactcggggctctccctcagcttcgggttcctgagacaaagggctttcttctgcggcaggtctagcctgcctacagccgtgtcccactgccgcaggtttccttgtggcttctccgtagttttgactgtgcttccagacccttccaggtcagggctgtgttcttgtggcagggcacctggtggacccaggcacgtgaatgtggtatgtggttgtagcctcaatcgtggccatcggctccttggacagccacgagccattttcatacccaataatgaaagctgtgtgctagcttagaaatcaaagggggtgtaaaagcacacattctttgttttatgggtttttctctttttagaggacagagggacaaccacacgaggctgccagactcctgtcacctctacagtccccttagaaagccagagtttgcacagattgtgggtataactcctgtccccttaggtgttctatctccgaccttgatctttgccaaaatgtgtgtatgcagaactatttctgtgtattttccttgacacccgtcttagcacctgtgtagtttgtatccggttagaaaccttttctatggaaagctcagtaattcttattaagagattgctattgttcatgtaaaacatgaaaacaaccaagtagagccgtgtgtggatgagggcccactcagcactgtgcttgcttgaggggctctcggcaggaagtctccttctgacccatatccgctgaccacacctctccagcaagtgcctctgccgctggccagctcaaggtttgcccacctggccccgaagcaccgtgtttcggagttgggaggaactgtttggcattgttggcagaaggtgtgattgcctggagcagcagccttttaaattctggagaccctgtagtcctttgtatctcagacctttactgatgtaccaggtcccagattctgtggcaggggatggggtggggtgtgcttgccagacgaaatttaaattatctatcttttgggaagtgtgtgctttcctggaggtcactgtgaaaacaaacaaacaaatcaggaccgttaaccccttaatgcccacttaaactcaatttcatgttaggactcttgtttaaaaccatttgtggcctgtatgtgttcatcctggttagagagaaagctttatgacgctgtttctgttcaacacattaaccagctgtggaacagccctttttgcacgacaggcagggcacttcaggattcgcagagagactcgtgtggtttggaagtggtatttcctatgaaagcctctcacgttgcttgtaaagctaatctaattaaaaagatgtataaatgttcttgaaaaaaatc

SEQ ID NO: 6 - DNA, 2124 bp, Mus musculus
tgcccagcgggcgaggcgggggcggggcgtcgcgggcggtggggggcggggtatggcgcgctgcgaagcgcagggcggctggcacaaacggcggcgccgaggccggaggaaaaagctcgccacccccatcagtcccttctcaagctcctagagacaactgtggacttggggaccagcgagcacccccagagcactagaggagcccctgctgcctgccctgcctcaccctgccccacacgaggcccagcggccccgggctgcatcaagtggaggaggaggaggcggaggagggtggcaccatgggcccgggccgtgccctccatgcccgggggatgaagacactgctgccatggacagcccgtgccagccgcaggccctgaatcaagctctccctcagttgccagggtctgtgtcagagtccttggagtctagccgagccagaatgggggtggagagttacctgccctgccctctgctcccggcctatcaccgtccaggagcatctggggaggcctcggctggcaatgggacccccagaaccacagccactgctactacgaccactgccagtcccctgcgggagggctttggtgggcaggatggtggtgagctttggccactgcagagtgaaggtgctgctgcgttggtcaccaaggagtgccagcgactggcggcccagggtgcccggcctgaggcccccaaacggaagtgggccaaggatggtggggatgccccttcacccagcaagcgaccgtgggccaggcaagagaaccaggaggccaagggggaaagtggtatgggctgtgacagcggtgccagcaacagcagcagcagcagcagcaacactaccagtagcagtggcgaggcaagtgctaggctgagggaggaagtccagccctctgcacctgagcgcctggccctggactatattgtgccttgcatgcggtactatggtatctgtgtcaaggacaacttcttgggggcagtactgggtggccgtgtgctggctgaggtggaagccctgaagtggggcgggcgtcttcgtgatgggcaactagtgagccagcgggcgatcccaccgcgcagcattcgtggggaccagattgcctgggtagaaggtcacgagccaggctgccggagcattggtgccctcatggctcacgtggacgcagtaatccgccactgtgcagggcggctgggcaactacgtcatcaatgggcgcaccaaggccatggtggcgtgttatccaggcaatgggctcgggtacgtgaggcatgttgacaatccccacggcgatgggcgctgcatcacctgtatctattacctgaatcagaactgggatgttaaggtgcatggcggcctgctgcagatcttccccgagggtcggccagtggtagccaacatcgagccactctttgaccggttgctcattttctggtctgaccgacggaacccacatgaggtgaagccagcctatgccaccaggtacgccatcactgtctggtattttgatgccaaggaacgggcagcagccagagacaagtatcagctagcatcgggacagaaaggtgttcaagtaccagtatcacagccaactacacctacctaatggccagccccagagctgcgtggaccagcagcagctcctgcctcagtgcccgctcctttcctgccactgctgctgcttctggcttgcctctgtactgtgtggtgtggagggcactaagtatcactgaggagcaacaaggagagacctctgctgccccgtgagcgagcggtgctgggttttgacctgggcagtggccagtgtggctggcggtcatgactggtggctgtgtctggtccgttgagtgtagagctgagaagaggcaggatttggggttgaggtgagtcatggcctcttgctggaaaggtgtgttggggtgtgggtgtcatctcaccctcgtccccactcctccggcctggaatgtgaagtgactccccagcccctttggctgtggcagtgtatggactgggctgccactgtctgggcagagtagggtgccatgacgagcatgggtatggaggttctgccagccaagaaataaaagtttacctcagagctgcaaaaaaaaaaaaaaaaaa

SEQ ID NO: 7 - DNA, 2693 bp, Mus musculus
cctcccccggccacggccgccgcggcggtggctctgcatctccaaaaagggccctccgacttctcactgggccagtccggcgctgggtggcggagccctacactgctcccgccggtcccagagccgggatcccttctcttcagagtttcgagcaactttccccgcctctggagctaaagtggctcggggactgtgaccaccgcaggtgggagagtccccggcccggctctccgcatcttcgctgtgcgctcgcgctgggaaagccctgggtgcgtgcaccctgggggtccccggcctcggctctgtgggcgagatgcctctgggacacatcatgaggctggatctggagaagatcgccctggagtacatcgtgccctgtctgcacgaggtcggcttctgctacctggacaacttcctaggcgaggtggtgggcgactgcgtgctggagcgagtcaagcagctgcactacaacggggccctgcgtgacggccagctggccgggccgtgcgccggcgtctccaagcggcacctgcgaggcgaccagatcacgtggatcgggggcaacgaggagggctgcgaggccatcaacttcctcctgtccctcatcgaccggctggtcctgtactgcgggagccggctgggcaaatactatgtcaaggagcggtccaaggcaatggtggcttgctatccaggaaatgggacaggttatgttcgccatgtggacaaccccaatggtgatggccgctgtatcacctgtatctactacctgaataagaattgggacgccaagttacacggaggggtcctgcggatatttccggaagggaaatcgtttgtagcagacgtggagcccatttttgacagacttctgttcttctggtcagaccgcaggaatccacatgaagtccagccctcctatgccaccaggtacgctatgactgtctggtacttcgatgctgaagaaagggcagaagccaaaaagaaattcaggaatttaactagaaaaactgaatctgctcttgctaaagactgactgtggtgtgcaatccgctggccgcattcgtgtagtaacagttccggaaatgttaagtgtcaagatccaaagaatccatacaatcccctctgcccacgtcgttcagctccccaccttgtttgtggtacttcatgttttcttgccgggactgcggtgaccttcagacactctctttgccagatgaactcatttgctaactccagaaatacctgcagacgacatcctagctggccagcggtttaaagatagatttgggaattcggctgttgagcccaggactgcttcttattcgcactttatgtatgcgtcctgatttgaagggaggaggttcgcaaagaaataaagttggtgacagatgccacgaaggggtaccctccaaaccctcacagcaagaaagagaaatatctgaacgatttccagatgttgttaaccagagtctagacagtgacgacgacctaatgacattatcacctctagaaagggctgctgcttagcaatcgatttatagatatcccacggtggatgctccattttcctggtttacgacccgtactttctgaaggtcattgctaagtcaatggctctcttgtggaagatgatcccagcatttattatgcactatgtttacttcttacttggggaacctaattatccagagaataaaattcgccaggtagtttgggttgtttttctggtattgaaatttgaagttaaatcagaggatagaaagcttcctggtaattcagcactggattctgctaactctatgggaagagcaaagcccaacttacatgattcgtccgagcatccccatcccgagcagttcagttcggggagggagatggggttggaagtgcagacagggtcctttcatccgtgtgtgttccctttaacggttcatcgtccataacaaagaacagtgtgctgtactcttaaaagagatggaaataaaaagacctcagagctattggagttcttccacatcatctgctctgccagcctcacttgagtcgtcttgatccttgactgcaactggctggtaggacggccagagttgtgggatttcccagaaccgtgggagggtctcctgctgcagggggcaggtgtcgcttcctcccgaactctgtacgaaacacctattttacgaaagttagccaccctcgtttctgctgctacttccccaactttcaaacctctttaatttcctagctagaatcccacaagcagcatagacctgaaagtgttttatttcgtcatgttcagacagatagacagacagactttccaagacagaagttgatacttttcctctaattgttttggaaagtgtccaggaagaactgtcatcccacccccacccccaacaccccacccccgcccccaacacccccacccgtgccccgtcccgtggctcagttttgttttatttagtatttcccaccttctaacttgcaatgtcatgtccttatttattttgtttattgtctctttagcctgtgatgcctagagtgttaagtacaacgaagacagggattttgtacatttttgacccatgcaatattcccagcgcctaacctaatgcctggcatatagcaagaaagggcttagtaaatacatgctcaataaactcagtctcctctgtaaaaaaaaaaaaaaaaaa

SEQ ID NO: 8 - DNA, 21 bp, Artificial Sequence
  Description of Artificial Sequence: Synthetic Control duplex sense strand oligonucleotide
  Description of Combined DNA/RNA Molecule: Synthetic Control duplex sense strand oligonucleotide
cuuacgcugaguacuucgatt

SEQ ID NO: 9 - DNA, 21 bp, Artificial Sequence
  Description of Artificial Sequence: Synthetic Control duplex antisense strand oligonucleotide
  Description of Combined DNA/RNA Molecule: Synthetic Control duplex antisense strand oligonucleotide
ucgaaguacucagcguaagtt

SEQ ID NO: 10 - RNA, 19 nt, Artificial Sequence
  Description of Artificial Sequence: Synthetic iRNA agent oligonucleotide
gcuauguccgucacguuga

SEQ ID NO: 11 - RNA, 19 nt, Artificial Sequence
  Description of Artificial Sequence: Synthetic iRNA agent oligonucleotide
ucaacgugacggacauagc

SEQ ID NO: 12 - RNA, 19 nt, Artificial Sequence
  Description of Artificial Sequence: Synthetic iRNA agent oligonucleotide
cgucacguugauaacccaa

SEQ ID NO: 13 - RNA, 19 nt, Artificial Sequence
  Description of Artificial Sequence: Synthetic iRNA agent oligonucleotide
uuggguuaucaacgugacg

SEQ ID NO: 14 - RNA, 19 nt, Artificial Sequence
  Description of Artificial Sequence: Synthetic iRNA agent oligonucleotide
ggaagaugcgugacaugua

SEQ ID NO: 15 - RNA, 19 nt, Artificial Sequence
  Description of Artificial Sequence: Synthetic iRNA agent oligonucleotide
uacaugucacgcaucuucc

SEQ ID NO: 16 - RNA, 19 nt, Artificial Sequence
  Description of Artificial Sequence: Synthetic iRNA agent oligonucleotide
gacugggacgccaagguaa

SEQ ID NO: 17 - RNA, 19 nt, Artificial Sequence
  Description of Artificial Sequence: Synthetic iRNA agent oligonucleotide
uuaccuuggcgucccaguc

SEQ ID NO: 18 - RNA, 19 nt, Artificial Sequence
  Description of Artificial Sequence: Synthetic iRNA agent oligonucleotide
gagguauucuucgaauuuu

SEQ ID NO: 19 - RNA, 19 nt, Artificial Sequence
  Description of Artificial Sequence: Synthetic iRNA agent oligonucleotide
aaaauucgaagaauaccuc

SEQ ID NO: 20 - RNA, 19 nt, Artificial Sequence
  Description of Artificial Sequence: Synthetic iRNA agent oligonucleotide
ggcguaacccucaugaagu

SEQ ID NO: 21 - RNA, 19 nt, Artificial Sequence
  Description of Artificial Sequence: Synthetic iRNA agent oligonucleotide
acuucaugaggguuacgcc

SEQ ID NO: 22 - RNA, 19 nt, Artificial Sequence
  Description of Artificial Sequence: Synthetic iRNA agent oligonucleotide
cgccacaagguacgcaaua

SEQ ID NO: 23 - RNA, 19 nt, Artificial Sequence
  Description of Artificial Sequence: Synthetic iRNA agent oligonucleotide
uauugcguaccuuguggcg

SEQ ID NO: 24 - RNA, 19 nt, Artificial Sequence
  Description of Artificial Sequence: Synthetic iRNA agent oligonucleotide
gccacaagguacgcaauaa

SEQ ID NO: 25 - RNA, 19 nt, Artificial Sequence
  Description of Artificial Sequence: Synthetic iRNA agent oligonucleotide
uuauugcguaccuuguggc

SEQ ID NO: 26 - RNA, 19 nt, Artificial Sequence
  Description of Artificial Sequence: Synthetic iRNA agent oligonucleotide
caagguacgcaauaacugu

SEQ ID NO: 27 - RNA, 19 nt, Artificial Sequence
  Description of Artificial Sequence: Synthetic iRNA agent oligonucleotide
acaguuauugcguaccuug

SEQ ID NO: 28 - RNA, 19 nt, Artificial Sequence
  Description of Artificial Sequence: Synthetic iRNA agent oligonucleotide
cgagcgagagcuaaaguaa

SEQ ID NO: 29 - RNA, 19 nt, Artificial Sequence
  Description of Artificial Sequence: Synthetic iRNA agent oligonucleotide
uuacuuuagcucucgcucg

SEQ ID NO: 30 - RNA, 19 nt, Artificial Sequence
  Description of Artificial Sequence: Synthetic iRNA agent oligonucleotide
gcgagagcuaaaguaaaau

SEQ ID NO: 31 - RNA, 19 nt, Artificial Sequence
  Description of Artificial Sequence: Synthetic iRNA agent oligonucleotide
auuuuacuuuagcucucgc

SEQ ID NO: 32 - RNA, 19 nt, Artificial Sequence
  Description of Artificial Sequence: Synthetic iRNA agent oligonucleotide
ggugugaggguugaacuca

SEQ ID NO: 33 - RNA, 19 nt, Artificial Sequence
  Description of Artificial Sequence: Synthetic iRNA agent oligonucleotide
ugaguucaacccucacacc

SEQ ID NO: 34 - RNA, 19 nt, Artificial Sequence
  Description of Artificial Sequence: Synthetic iRNA agent oligonucleotide
gucagcaaagacgucuagu

SEQ ID NO: 35 - RNA, 19 nt, Artificial Sequence
  Description of Artificial Sequence: Synthetic iRNA agent oligonucleotide
acuagacgucuuugcugac

SEQ ID NO: 36 - RNA, 19 nt, Artificial Sequence
  Description of Artificial Sequence: Synthetic iRNA agent oligonucleotide
gccuccugcgaugauuguu

SEQ ID NO: 37 - RNA, 19 nt, Artificial Sequence
  Description of Artificial Sequence: Synthetic iRNA agent oligonucleotide
aacaaucaucgcaggaggc

SEQ ID NO: 38 - RNA, 19 nt, Artificial Sequence
  Description of Artificial Sequence: Synthetic iRNA agent oligonucleotide
gugacgacguguugcuucu

SEQ ID NO: 39 - RNA, 19 nt, Artificial Sequence
  Description of Artificial Sequence: Synthetic iRNA agent oligonucleotide
agaagcaacacgucgucac

SEQ ID NO: 40 - RNA, 19 nt, Artificial Sequence
  Description of Artificial Sequence: Synthetic iRNA agent oligonucleotide
cgcuucgaccgaccuaaca

SEQ ID NO: 41 - RNA, 19 nt, Artificial Sequence
  Description of Artificial Sequence: Synthetic iRNA agent oligonucleotide
uguuaggucggucgaagcg

SEQ ID NO: 42 - RNA, 19 nt, Artificial Sequence
  Description of Artificial Sequence: Synthetic iRNA agent oligonucleotide
cgaccgaccuaacaguaga

SEQ ID NO: 43 - RNA, 19 nt, Artificial Sequence
  Description of Artificial Sequence: Synthetic iRNA agent oligonucleotide
ucuacuguuaggucggucg

SEQ ID NO: 44 - RNA, 19 nt, Artificial Sequence
  Description of Artificial Sequence: Synthetic iRNA agent oligonucleotide
caacauaguuacaagagga

SEQ ID NO: 45 - RNA, 19 nt, Artificial Sequence
  Description of Artificial Sequence: Synthetic iRNA agent oligonucleotide
uccucuuguaacuauguug

SEQ ID NO: 46 - RNA, 19 nt, Artificial Sequence
  Description of Artificial Sequence: Synthetic iRNA agent oligonucleotide
cgaagugacgggcacuaaa

SEQ ID NO: 47 - RNA, 19 nt, Artificial Sequence
  Description of Artificial Sequence: Synthetic iRNA agent oligonucleotide
uuuagugcccgucacuucg

SEQ ID NO: 48 - RNA, 19 nt, Artificial Sequence
  Description of Artificial Sequence: Synthetic iRNA agent oligonucleotide
gaagugacgggcacuaaau

SEQ ID NO: 49 - RNA, 19 nt, Artificial Sequence
  Description of Artificial Sequence: Synthetic iRNA agent oligonucleotide
auuuagugcccgucacuuc

SEQ ID NO: 50 - RNA, 19 nt, Artificial Sequence
  Description of Artificial Sequence: Synthetic iRNA agent oligonucleotide
gugaaugugguaugugguu

SEQ ID NO: 51 - RNA, 19 nt, Artificial Sequence
  Description of Artificial Sequence: Synthetic iRNA agent oligonucleotide
aaccacauaccacauucac

SEQ ID NO: 52 - RNA, 19 nt, Artificial Sequence
  Description of Artificial Sequence: Synthetic iRNA agent oligonucleotide
gcacagauuguggguauaa

SEQ ID NO: 53 - RNA, 19 nt, Artificial Sequence
  Description of Artificial Sequence: Synthetic iRNA agent oligonucleotide
uuauacccacaaucugugc

SEQ ID NO: 54 - RNA, 19 nt, Artificial Sequence
  Description of Artificial Sequence: Synthetic iRNA agent oligonucleotide
cuccuguccccuuaggugu

SEQ ID NO: 55 - RNA, 19 nt, Artificial Sequence
  Description of Artificial Sequence: Synthetic iRNA agent oligonucleotide
acaccuaaggggacaggag

SEQ ID NO: 56 - RNA, 19 nt, Artificial Sequence
  Description of Artificial Sequence: Synthetic iRNA agent oligonucleotide
guuuguauccgguuagaaa

SEQ ID NO: 57 - RNA, 19 nt, Artificial Sequence
  Description of Artificial Sequence: Synthetic iRNA agent oligonucleotide
uuucuaaccggauacaaac

SEQ ID NO: 58 - RNA, 19 nt, Artificial Sequence
  Description of Artificial Sequence: Synthetic iRNA agent oligonucleotide
gucuccuucugacccauau

SEQ ID NO: 59 - RNA, 19 nt, Artificial Sequence
  Description of Artificial Sequence: Synthetic iRNA agent oligonucleotide
auaugggucagaaggagac

SEQ ID NO: 60 - RNA, 19 nt, Artificial Sequence
  Description of Artificial Sequence: Synthetic iRNA agent oligonucleotide
cuucugacccauauccgcu

SEQ ID NO: 61 - RNA, 19 nt, Artificial Sequence
  Description of Artificial Sequence: Synthetic iRNA agent oligonucleotide
agcggauaugggucagaag

SEQ ID NO: 62 - RNA, 19 nt, Artificial Sequence
  Description of Artificial Sequence: Synthetic iRNA agent oligonucleotide
ggaacuguuuggcauuguu

SEQ ID NO: 63 - RNA, 19 nt, Artificial Sequence
  Description of Artificial Sequence: Synthetic iRNA agent oligonucleotide
aacaaugccaaacaguucc

SEQ ID NO: 64 - RNA, 19 nt, Artificial Sequence
  Description of Artificial Sequence: Synthetic iRNA agent oligonucleotide
cuuaaugcccacuuaaacu

SEQ ID NO: 65 - RNA, 19 nt, Artificial Sequence
  Description of Artificial Sequence: Synthetic iRNA agent oligonucleotide
aguuuaagugggcauuaag

SEQ ID NO: 66 - RNA, 19 nt, Artificial Sequence
  Description of Artificial Sequence: Synthetic iRNA agent oligonucleotide
guuaggacucuuguuuaaa

SEQ ID NO: 67 - RNA, 19 nt, Artificial Sequence
  Description of Artificial Sequence: Synthetic iRNA agent oligonucleotide
uuuaaacaagaguccuaac

SEQ ID NO: 68 - RNA, 19 nt, Artificial Sequence
  Description of Artificial Sequence: Synthetic iRNA agent oligonucleotide
cuguucaacacauuaacca

SEQ ID NO: 69 - RNA, 19 nt, Artificial Sequence
  Description of Artificial Sequence: Synthetic iRNA agent oligonucleotide
ugguuaauguguugaacag

SEQ ID NO: 70 - RNA, 19 nt, Artificial Sequence
  Description of Artificial Sequence: Synthetic iRNA agent oligonucleotide
gcuuguaaagcuaaucuaa

SEQ ID NO: 71 - RNA, 19 nt, Artificial Sequence
  Description of Artificial Sequence: Synthetic iRNA agent oligonucleotide
uuagauuagcuuuacaagc

SEQ ID NO: 72 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
gcuauguccgucacguugatt

SEQ ID NO: 73 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
ucaacgugacggacauagctt

SEQ ID NO: 74 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
cgucacguugauaacccaatt

SEQ ID NO: 75 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
uuggguuaucaacgugacgtt

SEQ ID NO: 76 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
ggaagaugcgugacauguatt

SEQ ID NO: 77 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
uacaugucacgcaucuucctt

SEQ ID NO: 78 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
gacugggacgccaagguaatt

SEQ ID NO: 79 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
uuaccuuggcgucccaguctt

SEQ ID NO: 80 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
gagguauucuucgaauuuutt

SEQ ID NO: 81 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
aaaauucgaagaauaccuctt

SEQ ID NO: 82 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
ggcguaacccucaugaagutt

SEQ ID NO: 83 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
acuucaugaggguuacgcctt

SEQ ID NO: 84 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
cgccacaagguacgcaauatt

SEQ ID NO: 85 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
uauugcguaccuuguggcgtt

SEQ ID NO: 86 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
gccacaagguacgcaauaatt

SEQ ID NO: 87 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
uuauugcguaccuuguggctt

SEQ ID NO: 88 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
caagguacgcaauaacugutt

SEQ ID NO: 89 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
acaguuauugcguaccuugtt

SEQ ID NO: 90 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
cgagcgagagcuaaaguaatt

SEQ ID NO: 91 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
uuacuuuagcucucgcucgtt

SEQ ID NO: 92 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
gcgagagcuaaaguaaaautt

SEQ ID NO: 93 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
auuuuacuuuagcucucgctt

SEQ ID NO: 94 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
ggugugaggguugaacucatt

SEQ ID NO: 95 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
ugaguucaacccucacacctt

SEQ ID NO: 96 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
gucagcaaagacgucuagutt

SEQ ID NO: 97 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
acuagacgucuuugcugactt

SEQ ID NO: 98 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
gccuccugcgaugauuguutt

SEQ ID NO: 99 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
aacaaucaucgcaggaggctt

SEQ ID NO: 100 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
gugacgacguguugcuucutt

SEQ ID NO: 101 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
agaagcaacacgucgucactt

SEQ ID NO: 102 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
cgcuucgaccgaccuaacatt

SEQ ID NO: 103 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
uguuaggucggucgaagcgtt

SEQ ID NO: 104 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
cgaccgaccuaacaguagatt

SEQ ID NO: 105 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
ucuacuguuaggucggucgtt

SEQ ID NO: 106 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
caacauaguuacaagaggatt

SEQ ID NO: 107 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
uccucuuguaacuauguugtt

SEQ ID NO: 108 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
cgaagugacgggcacuaaatt

SEQ ID NO: 109 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
uuuagugcccgucacuucgtt

SEQ ID NO: 110 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
gaagugacgggcacuaaautt

SEQ ID NO: 111 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
auuuagugcccgucacuuctt

SEQ ID NO: 112 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
gugaaugugguaugugguutt

SEQ ID NO: 113 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
aaccacauaccacauucactt

SEQ ID NO: 114 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
gcacagauuguggguauaatt

SEQ ID NO: 115 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
uuauacccacaaucugugctt

SEQ ID NO: 116 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
cuccuguccccuuaggugutt

SEQ ID NO: 117 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
acaccuaaggggacaggagtt

SEQ ID NO: 118 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
guuuguauccgguuagaaatt

SEQ ID NO: 119 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
uuucuaaccggauacaaactt

SEQ ID NO: 120 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
gucuccuucugacccauautt

SEQ ID NO: 121 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
auaugggucagaaggagactt

SEQ ID NO: 122 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
cuucugacccauauccgcutt

SEQ ID NO: 123 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
agcggauaugggucagaagtt

SEQ ID NO: 124 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
ggaacuguuuggcauuguutt

SEQ ID NO: 125 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
aacaaugccaaacaguucctt

SEQ ID NO: 126 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
cuuaaugcccacuuaaacutt

SEQ ID NO: 127 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
aguuuaagugggcauuaagtt

SEQ ID NO: 128 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
guuaggacucuuguuuaaatt

SEQ ID NO: 129 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
uuuaaacaagaguccuaactt

SEQ ID NO: 130 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
cuguucaacacauuaaccatt

SEQ ID NO: 131 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
ugguuaauguguugaacagtt

SEQ ID NO: 132 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
gcuuguaaagcuaaucuaatt

SEQ ID NO: 133 - DNA, 21 bp, Artificial Sequence
  Description of Artificial Sequence: Synthetic iRNA agent oligonucleotide
  Description of Combined DNA/RNA Molecule: Synthetic iRNA agent oligonucleotide
uuagauuagcuuuacaagctt

SEQ ID NO: 134 - RNA, 19 nt, Artificial Sequence
  Description of Artificial Sequence: Synthetic EGLN2 iRNA agent oligonucleotide
aucagucccuucucaagcu

SEQ ID NO: 135 - RNA, 19 nt, Artificial Sequence
  Description of Artificial Sequence: Synthetic EGLN2 iRNA agent oligonucleotide
agcuugagaagggacugau

SEQ ID NO: 136 - RNA, 19 nt, Artificial Sequence
  Description of Artificial Sequence: Synthetic EGLN2 iRNA agent oligonucleotide
guccuuggagucuagccga

SEQ ID NO: 137 - RNA, 19 nt, Artificial Sequence
  Description of Artificial Sequence: Synthetic EGLN2 iRNA agent oligonucleotide
ucggcuagacuccaaggac

SEQ ID NO: 138 - RNA, 19 nt, Artificial Sequence
  Description of Artificial Sequence: Synthetic EGLN2 iRNA agent oligonucleotide
gccacugcuacuacgacca

SEQ ID NO: 139 - RNA, 19 nt, Artificial Sequence
  Description of Artificial Sequence: Synthetic EGLN2 iRNA agent oligonucleotide
uggucguaguagcaguggc

SEQ ID NO: 140 - RNA, 19 nt, Artificial Sequence
  Description of Artificial Sequence: Synthetic EGLN2 iRNA agent oligonucleotide
gccuugcaugcgguacuau

SEQ ID NO: 141 - RNA, 19 nt, Artificial Sequence
  Description of Artificial Sequence: Synthetic EGLN2 iRNA agent oligonucleotide
auaguaccgcaugcaaggc

SEQ ID NO: 142 - RNA, 19 nt, Artificial Sequence
  Description of Artificial Sequence: Synthetic EGLN2 iRNA agent oligonucleotide
augcgguacuaugguaucu

SEQ ID NO: 143 - RNA, 19 nt, Artificial Sequence
  Description of Artificial Sequence: Synthetic EGLN2 iRNA agent oligonucleotide
agauaccauaguaccgcau

SEQ ID NO: 144 - RNA, 19 nt, Artificial Sequence
  Description of Artificial Sequence: Synthetic EGLN2 iRNA agent oligonucleotide
gcgguacuaugguaucugu

SEQ ID NO: 145 - RNA, 19 nt, Artificial Sequence
  Description of Artificial Sequence: Synthetic EGLN2 iRNA agent oligonucleotide
acagauaccauaguaccgc

SEQ ID NO: 146 - RNA, 19 nt, Artificial Sequence
  Description of Artificial Sequence: Synthetic EGLN2 iRNA agent oligonucleotide
aucugugucaaggacaacu

SEQ ID NO: 147 - RNA, 19 nt, Artificial Sequence
  Description of Artificial Sequence: Synthetic EGLN2 iRNA agent oligonucleotide
aguuguccuugacacagau

SEQ ID NO: 148 - RNA, 19 nt, Artificial Sequence
  Description of Artificial Sequence: Synthetic EGLN2 iRNA agent oligonucleotide
cgugaugggcaacuaguga

SEQ ID NO: 149 - RNA, 19 nt, Artificial Sequence
  Description of Artificial Sequence: Synthetic EGLN2 iRNA agent oligonucleotide
ucacuaguugcccaucacg

SEQ ID NO: 150 - RNA, 19 nt, Artificial Sequence
  Description of Artificial Sequence: Synthetic EGLN2 iRNA agent oligonucleotide
ccuggguagaaggucacga

SEQ ID NO: 151 - RNA, 19 nt, Artificial Sequence
  Description of Artificial Sequence: Synthetic EGLN2 iRNA agent oligonucleotide
ucgugaccuucuacccagg

SEQ ID NO: 152 - RNA, 19 nt, Artificial Sequence
  Description of Artificial Sequence: Synthetic EGLN2 iRNA agent oligonucleotide
cucacguggacgcaguaau

SEQ ID NO: 153 - RNA, 19 nt, Artificial Sequence
  Description of Artificial Sequence: Synthetic EGLN2 iRNA agent oligonucleotide
auuacugcguccacgugag

SEQ ID NO: 154 - RNA, 19 nt, Artificial Sequence
  Description of Artificial Sequence: Synthetic EGLN2 iRNA agent oligonucleotide
ggccaugguggcguguuau

SEQ ID NO: 155 - RNA, 19 nt, Artificial Sequence
  Description of Artificial Sequence: Synthetic EGLN2 iRNA agent oligonucleotide
auaacacgccaccauggcc

SEQ ID NO: 156 - RNA, 19 nt, Artificial Sequence
  Description of Artificial Sequence: Synthetic EGLN2 iRNA agent oligonucleotide
guggcguguuauccaggca

SEQ ID NO: 157 - RNA, 19 nt, Artificial Sequence
  Description of Artificial Sequence: Synthetic EGLN2 iRNA agent oligonucleotide
ugccuggauaacacgccac

SEQ ID NO: 158 - RNA, 19 nt, Artificial Sequence
  Description of Artificial Sequence: Synthetic EGLN2 iRNA agent oligonucleotide
aaugggcucggguacguga

SEQ ID NO: 159 - RNA, 19 nt, Artificial Sequence
  Description of Artificial Sequence: Synthetic EGLN2 iRNA agent oligonucleotide
ucacguacccgagcccauu

SEQ ID NO: 160 - RNA, 19 nt, Artificial Sequence
  Description of Artificial Sequence: Synthetic EGLN2 iRNA agent oligonucleotide
cggguacgugaggcauguu

SEQ ID NO: 161 - RNA, 19 nt, Artificial Sequence
  Description of Artificial Sequence: Synthetic EGLN2 iRNA agent oligonucleotide
aacaugccucacguacccg

SEQ ID NO: 162 - RNA, 19 nt, Artificial Sequence
  Description of Artificial Sequence: Synthetic EGLN2 iRNA agent oligonucleotide
gguacgugaggcauguuga

SEQ ID NO: 163 - RNA, 19 nt, Artificial Sequence
  Description of Artificial Sequence: Synthetic EGLN2 iRNA agent oligonucleotide
ucaacaugccucacguacc

SEQ ID NO: 164 - RNA, 19 nt, Artificial Sequence
  Description of Artificial Sequence: Synthetic EGLN2 iRNA agent oligonucleotide
ggcauguugacaaucccca

SEQ ID NO: 165 - RNA, 19 nt, Artificial Sequence
  Description of Artificial Sequence: Synthetic EGLN2 iRNA agent oligonucleotide
uggggauugucaacaugcc

SEQ ID NO: 166 - RNA, 19 nt, Artificial Sequence
  Description of Artificial Sequence: Synthetic EGLN2 iRNA agent oligonucleotide
gcaucaccuguaucuauua

SEQ ID NO: 167 - RNA, 19 nt, Artificial Sequence
  Description of Artificial Sequence: Synthetic EGLN2 iRNA agent oligonucleotide
uaauagauacaggugaugc

SEQ ID NO: 168 - RNA, 19 nt, Artificial Sequence
  Description of Artificial Sequence: Synthetic EGLN2 iRNA agent oligonucleotide
aucagaacugggauguuaa

SEQ ID NO: 169 - RNA, 19 nt, Artificial Sequence
  Description of Artificial Sequence: Synthetic EGLN2 iRNA agent oligonucleotide
uuaacaucccaguucugau

SEQ ID NO: 170 - RNA, 19 nt, Artificial Sequence
  Description of Artificial Sequence: Synthetic EGLN2 iRNA agent oligonucleotide
acugggauguuaaggugca

SEQ ID NO: 171 - RNA, 19 nt, Artificial Sequence
  Description of Artificial Sequence: Synthetic EGLN2 iRNA agent oligonucleotide
ugcaccuuaacaucccagu

SEQ ID NO: 172 - RNA, 19 nt, Artificial Sequence
  Description of Artificial Sequence: Synthetic EGLN2 iRNA agent oligonucleotide
caacaucgagccacucuuu

SEQ ID NO: 173 - RNA, 19 nt, Artificial Sequence
  Description of Artificial Sequence: Synthetic EGLN2 iRNA agent oligonucleotide
aaagaguggcucgauguug

SEQ ID NO: 174 - RNA, 19 nt, Artificial Sequence
  Description of Artificial Sequence: Synthetic EGLN2 iRNA agent oligonucleotide
cagagacaaguaucagcua

SEQ ID NO: 175 - RNA, 19 nt, Artificial Sequence
  Description of Artificial Sequence: Synthetic EGLN2 iRNA agent oligonucleotide
uagcugauacuugucucug

SEQ ID NO: 176 - RNA, 19 nt, Artificial Sequence
  Description of Artificial Sequence: Synthetic EGLN2 iRNA agent oligonucleotide
agacaaguaucagcuagca

SEQ ID NO: 177 - RNA, 19 nt, Artificial Sequence
  Description of Artificial Sequence: Synthetic EGLN2 iRNA agent oligonucleotide
ugcuagcugauacuugucu

SEQ ID NO: 178 - RNA, 19 nt, Artificial Sequence
  Description of Artificial Sequence: Synthetic EGLN2 iRNA agent oligonucleotide
aucgggacagaaagguguu

SEQ ID NO: 179 - RNA, 19 nt, Artificial Sequence
  Description of Artificial Sequence: Synthetic EGLN2 iRNA agent oligonucleotide
aacaccuuucugucccgau

SEQ ID NO: 180 - RNA, 19 nt, Artificial Sequence
  Description of Artificial Sequence: Synthetic EGLN2 iRNA agent oligonucleotide
agguguucaaguaccagua

SEQ ID NO: 181 - RNA, 19 nt, Artificial Sequence
  Description of Artificial Sequence: Synthetic EGLN2 iRNA agent oligonucleotide
uacugguacuugaacaccu

SEQ ID NO: 182 - RNA, 19 nt, Artificial Sequence
  Description of Artificial Sequence: Synthetic EGLN2 iRNA agent oligonucleotide
gugguguggagggcacuaa

SEQ ID NO: 183 - RNA, 19 nt, Artificial Sequence
  Description of Artificial Sequence: Synthetic EGLN2 iRNA agent oligonucleotide
uuagugcccuccacaccac

SEQ ID NO: 184 - RNA, 19 nt, Artificial Sequence
  Description of Artificial Sequence: Synthetic EGLN2 iRNA agent oligonucleotide
gguguggagggcacuaagu

SEQ ID NO: 185 - RNA, 19 nt, Artificial Sequence
  Description of Artificial Sequence: Synthetic EGLN2 iRNA agent oligonucleotide
acuuagugcccuccacacc

SEQ ID NO: 186 - RNA, 19 nt, Artificial Sequence
  Description of Artificial Sequence: Synthetic EGLN2 iRNA agent oligonucleotide
guguggagggcacuaagua

SEQ ID NO: 187 - RNA, 19 nt, Artificial Sequence
  Description of Artificial Sequence: Synthetic EGLN2 iRNA agent oligonucleotide
uacuuagugcccuccacac

SEQ ID NO: 188 - RNA, 19 nt, Artificial Sequence
  Description of Artificial Sequence: Synthetic EGLN2 iRNA agent oligonucleotide
uggcugugucugguccguu

SEQ ID NO: 189 - RNA, 19 nt, Artificial Sequence
  Description of Artificial Sequence: Synthetic EGLN2 iRNA agent oligonucleotide
aacggaccagacacagcca

SEQ ID NO: 190 - RNA, 19 nt, Artificial Sequence
  Description of Artificial Sequence: Synthetic EGLN2 iRNA agent oligonucleotide
ggauuugggguugagguga

SEQ ID NO: 191 - RNA, 19 nt, Artificial Sequence
  Description of Artificial Sequence: Synthetic EGLN2 iRNA agent oligonucleotide
ucaccucaaccccaaaucc

SEQ ID NO: 192 - RNA, 19 nt, Artificial Sequence
  Description of Artificial Sequence: Synthetic EGLN2 iRNA agent oligonucleotide
uugggguugaggugaguca

SEQ ID NO: 193 - RNA, 19 nt, Artificial Sequence
  Description of Artificial Sequence: Synthetic EGLN2 iRNA agent oligonucleotide
ugacucaccucaaccccaa

SEQ ID NO: 194 - RNA, 19 nt, Artificial Sequence
  Description of Artificial Sequence: Synthetic EGLN2 iRNA agent oligonucleotide
guuggggugugggugucau

SEQ ID NO: 195 - RNA, 19 nt, Artificial Sequence
  Description of Artificial Sequence: Synthetic EGLN2 iRNA agent oligonucleotide
augacacccacaccccaac

SEQ ID NO: 196 - RNA, 19 nt, Artificial Sequence
  Description of Artificial Sequence: Synthetic EGLN2 iRNA agent oligonucleotide
agggugccaugacgagcau

SEQ ID NO: 197 - RNA, 19 nt, Artificial Sequence
  Description of Artificial Sequence: Synthetic EGLN2 iRNA agent oligonucleotide
augcucgucauggcacccu

SEQ ID NO: 198 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
aucagucccuucucaagcutt

SEQ ID NO: 199 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
agcuugagaagggacugautt

SEQ ID NO: 200 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
guccuuggagucuagccgatt

SEQ ID NO: 201 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ucggcuagacuccaaggactt

SEQ ID NO: 202 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
gccacugcuacuacgaccatt

SEQ ID NO: 203 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
uggucguaguagcaguggctt

SEQ ID NO: 204 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
gccuugcaugcgguacuautt

SEQ ID NO: 205 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
auaguaccgcaugcaaggctt

SEQ ID NO: 206 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
augcgguacuaugguaucutt

SEQ ID NO: 207 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
agauaccauaguaccgcautt

SEQ ID NO: 208 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
gcgguacuaugguaucugutt

SEQ ID NO: 209 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
acagauaccauaguaccgctt

SEQ ID NO: 210 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
aucugugucaaggacaacutt

SEQ ID NO: 211 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
aguuguccuugacacagautt

SEQ ID NO: 212 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
cgugaugggcaacuagugatt

SEQ ID NO: 213 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ucacuaguugcccaucacgtt

SEQ ID NO: 214 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ccuggguagaaggucacgatt

SEQ ID NO: 215 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ucgugaccuucuacccaggtt

SEQ ID NO: 216 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
cucacguggacgcaguaautt

SEQ ID NO: 217 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
auuacugcguccacgugagtt

SEQ ID NO: 218 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ggccaugguggcguguuautt

SEQ ID NO: 219 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
auaacacgccaccauggcctt

SEQ ID NO: 220 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
guggcguguuauccaggcatt

SEQ ID NO: 221 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ugccuggauaacacgccactt

SEQ ID NO: 222 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
aaugggcucggguacgugatt

SEQ ID NO: 223 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ucacguacccgagcccauutt

SEQ ID NO: 224 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
cggguacgugaggcauguutt

SEQ ID NO: 225 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
aacaugccucacguacccgtt

SEQ ID NO: 226 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
gguacgugaggcauguugatt

SEQ ID NO: 227 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ucaacaugccucacguacctt

SEQ ID NO: 228 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ggcauguugacaauccccatt

SEQ ID NO: 229 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
uggggauugucaacaugcctt

SEQ ID NO: 230 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
gcaucaccuguaucuauuatt

SEQ ID NO: 231 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
uaauagauacaggugaugctt

SEQ ID NO: 232 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
aucagaacugggauguuaatt

SEQ ID NO: 233 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
uuaacaucccaguucugautt

SEQ ID NO: 234 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
acugggauguuaaggugcatt

SEQ ID NO: 235 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ugcaccuuaacaucccagutt

SEQ ID NO: 236 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
caacaucgagccacucuuutt

SEQ ID NO: 237 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
aaagaguggcucgauguugtt

SEQ ID NO: 238 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
cagagacaaguaucagcuatt

SEQ ID NO: 239 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
uagcugauacuugucucugtt

SEQ ID NO: 240 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
agacaaguaucagcuagcatt

SEQ ID NO: 241 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ugcuagcugauacuugucutt

SEQ ID NO: 242 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
aucgggacagaaagguguutt

SEQ ID NO: 243 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
aacaccuuucugucccgautt

SEQ ID NO: 244 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
agguguucaaguaccaguatt

SEQ ID NO: 245 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
uacugguacuugaacaccutt

SEQ ID NO: 246 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
gugguguggagggcacuaatt

SEQ ID NO: 247 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
uuagugcccuccacaccactt

SEQ ID NO: 248 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
gguguggagggcacuaagutt

SEQ ID NO: 249 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
acuuagugcccuccacacctt

SEQ ID NO: 250 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
guguggagggcacuaaguatt

SEQ ID NO: 251 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
uacuuagugcccuccacactt

SEQ ID NO: 252 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
uggcugugucugguccguutt

SEQ ID NO: 253 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
aacggaccagacacagccatt

SEQ ID NO: 254 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ggauuugggguugaggugatt

SEQ ID NO: 255 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ucaccucaaccccaaaucctt

SEQ ID NO: 256 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
uugggguugaggugagucatt

SEQ ID NO: 257 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
ugacucaccucaaccccaatt

SEQ ID NO: 258 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
guuggggugugggugucautt

SEQ ID NO: 259 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
augacacccacaccccaactt

SEQ ID NO: 260 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
agggugccaugacgagcautt

SEQ ID NO: 261 - DNA, 21 bp, Artificial Sequence
  Description of Artificial Sequence: Synthetic EGLN2 iRNA agent oligonucleotide
  Description of Combined DNA/RNA Molecule: Synthetic EGLN2 iRNA agent oligonucleotide
augcucgucauggcacccutt

SEQ ID NO: 262 - RNA, 19 nt, Artificial Sequence
  Description of Artificial Sequence: Synthetic EGLN3 iRNA agent oligonucleotide
ccggcugggcaaauacuau

SEQ ID NO: 263 - RNA, 19 nt, Artificial Sequence
  Description of Artificial Sequence: Synthetic EGLN3 iRNA agent oligonucleotide
auaguauuugcccagccgg

SEQ ID NO: 264 - RNA, 19 nt, Artificial Sequence
  Description of Artificial Sequence: Synthetic EGLN3 iRNA agent oligonucleotide
gaauugggacgccaaguua

SEQ ID NO: 265 - RNA, 19 nt, Artificial Sequence
  Description of Artificial Sequence: Synthetic EGLN3 iRNA agent oligonucleotide
uaacuuggcgucccaauuc

SEQ ID NO: 266 - RNA, 19 nt, Artificial Sequence
  Description of Artificial Sequence: Synthetic EGLN3 iRNA agent oligonucleotide
cggaagggaaaucguuugu

SEQ ID NO: 267 - RNA, 19 nt, Artificial Sequence
  Description of Artificial Sequence: Synthetic EGLN3 iRNA agent oligonucleotide
acaaacgauuucccuuccg

SEQ ID NO: 268 - RNA, 19 nt, Artificial Sequence
  Description of Artificial Sequence: Synthetic EGLN3 iRNA agent oligonucleotide
cagaccgcaggaauccaca

SEQ ID NO: 269 - RNA, 19 nt, Artificial Sequence
  Description of Artificial Sequence: Synthetic EGLN3 iRNA agent oligonucleotide
uguggauuccugcggucug

SEQ ID NO: 270 - RNA, 19 nt, Artificial Sequence
  Description of Artificial Sequence: Synthetic EGLN3 iRNA agent oligonucleotide
caccagguacgcuaugacu

SEQ ID NO: 271 - RNA, 19 nt, Artificial Sequence
  Description of Artificial Sequence: Synthetic EGLN3 iRNA agent oligonucleotide
agucauagcguaccuggug

SEQ ID NO: 272 - RNA, 19 nt, Artificial Sequence
  Description of Artificial Sequence: Synthetic EGLN3 iRNA agent oligonucleotide
ccagguacgcuaugacugu

SEQ ID NO: 273 - RNA, 19 nt, Artificial Sequence
  Description of Artificial Sequence: Synthetic EGLN3 iRNA agent oligonucleotide
acagucauagcguaccugg

SEQ ID NO: 274 - RNA, 19 nt, Artificial Sequence
  Description of Artificial Sequence: Synthetic EGLN3 iRNA agent oligonucleotide
gacugucugguacuucgau

SEQ ID NO: 275 - RNA, 19 nt, Artificial Sequence
  Description of Artificial Sequence: Synthetic EGLN3 iRNA agent oligonucleotide
aucgaaguaccagacaguc

SEQ ID NO: 276 - RNA, 19 nt, Artificial Sequence
  Description of Artificial Sequence: Synthetic EGLN3 iRNA agent oligonucleotide
ggccgcauucguguaguaa

SEQ ID NO: 277 - RNA, 19 nt, Artificial Sequence
  Description of Artificial Sequence: Synthetic EGLN3 iRNA agent oligonucleotide
uuacuacacgaaugcggcc

SEQ ID NO: 278 - RNA, 19 nt, Artificial Sequence
  Description of Artificial Sequence: Synthetic EGLN3 iRNA agent oligonucleotide
ccgcauucguguaguaaca

SEQ ID NO: 279 - RNA, 19 nt, Artificial Sequence
  Description of Artificial Sequence: Synthetic EGLN3 iRNA agent oligonucleotide
uguuacuacacgaaugcgg

SEQ ID NO: 280 - RNA, 19 nt, Artificial Sequence
  Description of Artificial Sequence: Synthetic EGLN3 iRNA agent oligonucleotide
cauucguguaguaacaguu

SEQ ID NO: 281 - RNA, 19 nt, Artificial Sequence
  Description of Artificial Sequence: Synthetic EGLN3 iRNA agent oligonucleotide
aacuguuacuacacgaaug

SEQ ID NO: 282 - RNA, 19 nt, Artificial Sequence
  Description of Artificial Sequence: Synthetic EGLN3 iRNA agent oligonucleotide
guaguaacaguuccggaaa

SEQ ID NO: 283 - RNA, 19 nt, Artificial Sequence
  Description of Artificial Sequence: Synthetic EGLN3 iRNA agent oligonucleotide
uuuccggaacuguuacuac

SEQ ID NO: 284 - RNA, 19 nt, Artificial Sequence
  Description of Artificial Sequence: Synthetic EGLN3 iRNA agent oligonucleotide
guaacaguuccggaaaugu

SEQ ID NO: 285 - RNA, 19 nt, Artificial Sequence
  Description of Artificial Sequence: Synthetic EGLN3 iRNA agent oligonucleotide
acauuuccggaacuguuac

SEQ ID NO: 286 - RNA, 19 nt, Artificial Sequence
  Description of Artificial Sequence: Synthetic EGLN3 iRNA agent oligonucleotide
ccagcgguuuaaagauaga

SEQ ID NO: 287 - RNA, 19 nt, Artificial Sequence
  Description of Artificial Sequence: Synthetic EGLN3 iRNA agent oligonucleotide
ucuaucuuuaaaccgcugg

SEQ ID NO: 288 - RNA, 19 nt, Artificial Sequence
  Description of Artificial Sequence: Synthetic EGLN3 iRNA agent oligonucleotide
ggacugcuucuuauucgca

SEQ ID NO: 289 - RNA, 19 nt, Artificial Sequence
  Description of Artificial Sequence: Synthetic EGLN3 iRNA agent oligonucleotide
ugcgaauaagaagcagucc

SEQ ID NO: 290 - RNA, 19 nt, Artificial Sequence
  Description of Artificial Sequence: Synthetic EGLN3 iRNA agent oligonucleotide
cugcuucuuauucgcacuu

SEQ ID NO: 291 - RNA, 19 nt, Artificial Sequence
  Description of Artificial Sequence: Synthetic EGLN3 iRNA agent oligonucleotide
aagugcgaauaagaagcag

SEQ ID NO: 292 - RNA, 19 nt, Artificial Sequence
  Description of Artificial Sequence: Synthetic EGLN3 iRNA agent oligonucleotide
cuuauucgcacuuuaugua

SEQ ID NO: 293 - RNA, 19 nt, Artificial Sequence
  Description of Artificial Sequence: Synthetic EGLN3 iRNA agent oligonucleotide
uacauaaagugcgaauaag

SEQ ID NO: 294 - RNA, 19 nt, Artificial Sequence
  Description of Artificial Sequence: Synthetic EGLN3 iRNA agent oligonucleotide
guaugcguccugauuugaa

SEQ ID NO: 295 - RNA, 19 nt, Artificial Sequence
  Description of Artificial Sequence: Synthetic EGLN3 iRNA agent oligonucleotide
uucaaaucaggacgcauac

SEQ ID NO: 296 - RNA, 19 nt, Artificial Sequence
  Description of Artificial Sequence: Synthetic EGLN3 iRNA agent oligonucleotide
gagguucgcaaagaaauaa

SEQ ID NO: 297 - RNA, 19 nt, Artificial Sequence
  Description of Artificial Sequence: Synthetic EGLN3 iRNA agent oligonucleotide
uuauuucuuugcgaaccuc

SEQ ID NO: 298 - RNA, 19 nt, Artificial Sequence
  Description of Artificial Sequence: Synthetic EGLN3 iRNA agent oligonucleotide
gacagugacgacgaccuaa

SEQ ID NO: 299 - RNA, 19 nt, Artificial Sequence
  Description of Artificial Sequence: Synthetic EGLN3 iRNA agent oligonucleotide
uuaggucgucgucacuguc

SEQ ID NO: 300 - RNA, 19 nt, Artificial Sequence
  Description of Artificial Sequence: Synthetic EGLN3 iRNA agent oligonucleotide
gacgacgaccuaaugacau

SEQ ID NO: 301 - RNA, 19 nt, Artificial Sequence
  Description of Artificial Sequence: Synthetic EGLN3 iRNA agent oligonucleotide
augucauuaggucgucguc

SEQ ID NO: 302 - RNA, 19 nt, Artificial Sequence
  Description of Artificial Sequence: Synthetic EGLN3 iRNA agent oligonucleotide
cgacgaccuaaugacauua

SEQ ID NO: 303 - RNA, 19 nt, Artificial Sequence
  Description of Artificial Sequence: Synthetic EGLN3 iRNA agent oligonucleotide
uaaugucauuaggucgucg

SEQ ID NO: 304 - RNA, 19 nt, Artificial Sequence
  Description of Artificial Sequence: Synthetic EGLN3 iRNA agent oligonucleotide
gcugcugcuuagcaaucga

SEQ ID NO: 305 - RNA, 19 nt, Artificial Sequence
  Description of Artificial Sequence: Synthetic EGLN3 iRNA agent oligonucleotide
ucgauugcuaagcagcagc

SEQ ID NO: 306 - RNA, 19 nt, Artificial Sequence
  Description of Artificial Sequence: Synthetic EGLN3 iRNA agent oligonucleotide
cugcugcuuagcaaucgau

SEQ ID NO: 307 - RNA, 19 nt, Artificial Sequence
  Description of Artificial Sequence: Synthetic EGLN3 iRNA agent oligonucleotide
aucgauugcuaagcagcag

SEQ ID NO: 308 - RNA, 19 nt, Artificial Sequence
  Description of Artificial Sequence: Synthetic EGLN3 iRNA agent oligonucleotide
cacgguggaugcuccauuu

SEQ ID NO: 309 - RNA, 19 nt, Artificial Sequence
  Description of Artificial Sequence: Synthetic EGLN3 iRNA agent oligonucleotide
aaauggagcauccaccgug

SEQ ID NO: 310 - RNA, 19 nt, Artificial Sequence
  Description of Artificial Sequence: Synthetic EGLN3 iRNA agent oligonucleotide
gguuuacgacccguacuuu

SEQ ID NO: 311 - RNA, 19 nt, Artificial Sequence
  Description of Artificial Sequence: Synthetic EGLN3 iRNA agent oligonucleotide
aaaguacgggucguaaacc

SEQ ID NO: 312 - RNA, 19 nt, Artificial Sequence
  Description of Artificial Sequence: Synthetic EGLN3 iRNA agent oligonucleotide
cccaacuuacaugauucgu

SEQ ID NO: 313 - RNA, 19 nt, Artificial Sequence
  Description of Artificial Sequence: Synthetic EGLN3 iRNA agent oligonucleotide
acgaaucauguaaguuggg

SEQ ID NO: 314 - RNA, 19 nt, Artificial Sequence
  Description of Artificial Sequence: Synthetic EGLN3 iRNA agent oligonucleotide
guucaucguccauaacaaa

SEQ ID NO: 315 - RNA, 19 nt, Artificial Sequence
  Description of Artificial Sequence: Synthetic EGLN3 iRNA agent oligonucleotide
uuuguuauggacgaugaac

SEQ ID NO: 316 - RNA, 19 nt, Artificial Sequence
  Description of Artificial Sequence: Synthetic EGLN3 iRNA agent oligonucleotide
cucacuugagucgucuuga

SEQ ID NO: 317 - RNA, 19 nt, Artificial Sequence
  Description of Artificial Sequence: Synthetic EGLN3 iRNA agent oligonucleotide
ucaagacgacucaagugag

SEQ ID NO: 318 - RNA, 19 nt, Artificial Sequence
  Description of Artificial Sequence: Synthetic EGLN3 iRNA agent oligonucleotide
ccucccgaacucuguacga

SEQ ID NO: 319 - RNA, 19 nt, Artificial Sequence
  Description of Artificial Sequence: Synthetic EGLN3 iRNA agent oligonucleotide
ucguacagaguucgggagg

SEQ ID NO: 320 - RNA, 19 nt, Artificial Sequence
  Description of Artificial Sequence: Synthetic EGLN3 iRNA agent oligonucleotide
cuguacgaaacaccuauuu

SEQ ID NO: 321 - RNA, 19 nt, Artificial Sequence
  Description of Artificial Sequence: Synthetic EGLN3 iRNA agent oligonucleotide
aaauagguguuucguacag

SEQ ID NO: 322 - RNA, 19 nt, Artificial Sequence
  Description of Artificial Sequence: Synthetic EGLN3 iRNA agent oligonucleotide
cgaaacaccuauuuuacga

SEQ ID NO: 323 - RNA, 19 nt, Artificial Sequence
  Description of Artificial Sequence: Synthetic EGLN3 iRNA agent oligonucleotide
ucguaaaauagguguuucg

SEQ ID NO: 324 - RNA, 19 nt, Artificial Sequence
  Description of Artificial Sequence: Synthetic EGLN3 iRNA agent oligonucleotide
gaaacaccuauuuuacgaa

SEQ ID NO: 325 - RNA, 19 nt, Artificial Sequence
  Description of Artificial Sequence: Synthetic EGLN3 iRNA agent oligonucleotide
uucguaaaauagguguuuc

SEQ ID NO: 326 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
ccggcugggcaaauacuautt

SEQ ID NO: 327 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
auaguauuugcccagccggtt

SEQ ID NO: 328 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
gaauugggacgccaaguuatt

SEQ ID NO: 329 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
uaacuuggcgucccaauuctt

SEQ ID NO: 330 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
cggaagggaaaucguuugutt

SEQ ID NO: 331 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
acaaacgauuucccuuccgtt

SEQ ID NO: 332 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
cagaccgcaggaauccacatt

SEQ ID NO: 333 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
uguggauuccugcggucugtt

SEQ ID NO: 334 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
caccagguacgcuaugacutt

SEQ ID NO: 335 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
agucauagcguaccuggugtt

SEQ ID NO: 336 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
ccagguacgcuaugacugutt

SEQ ID NO: 337 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
acagucauagcguaccuggtt

SEQ ID NO: 338 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
gacugucugguacuucgautt

SEQ ID NO: 339 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
aucgaaguaccagacaguctt

SEQ ID NO: 340 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
ggccgcauucguguaguaatt

SEQ ID NO: 341 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
uuacuacacgaaugcggcctt

SEQ ID NO: 342 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
ccgcauucguguaguaacatt

SEQ ID NO: 343 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
uguuacuacacgaaugcggtt

SEQ ID NO: 344 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
cauucguguaguaacaguutt

SEQ ID NO: 345 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
aacuguuacuacacgaaugtt

SEQ ID NO: 346 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
guaguaacaguuccggaaatt

SEQ ID NO: 347 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
uuuccggaacuguuacuactt

SEQ ID NO: 348 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
guaacaguuccggaaaugutt

SEQ ID NO: 349 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
acauuuccggaacuguuactt

SEQ ID NO: 350 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
ccagcgguuuaaagauagatt

SEQ ID NO: 351 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
ucuaucuuuaaaccgcuggtt

SEQ ID NO: 352 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
ggacugcuucuuauucgcatt

SEQ ID NO: 353 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
ugcgaauaagaagcagucctt

SEQ ID NO: 354 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
cugcuucuuauucgcacuutt

SEQ ID NO: 355 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
aagugcgaauaagaagcagtt

SEQ ID NO: 356 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
cuuauucgcacuuuauguatt

SEQ ID NO: 357 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
uacauaaagugcgaauaagtt

SEQ ID NO: 358 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
guaugcguccugauuugaatt

SEQ ID NO: 359 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
uucaaaucaggacgcauactt

SEQ ID NO: 360 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
gagguucgcaaagaaauaatt

SEQ ID NO: 361 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
uuauuucuuugcgaaccuctt

SEQ ID NO: 362 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
gacagugacgacgaccuaatt

SEQ ID NO: 363 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
uuaggucgucgucacuguctt

SEQ ID NO: 364 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
gacgacgaccuaaugacautt

SEQ ID NO: 365 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
augucauuaggucgucguctt

SEQ ID NO: 366 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
cgacgaccuaaugacauuatt

SEQ ID NO: 367 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
uaaugucauuaggucgucgtt

SEQ ID NO: 368 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
gcugcugcuuagcaaucgatt

SEQ ID NO: 369 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
ucgauugcuaagcagcagctt

SEQ ID NO: 370 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
cugcugcuuagcaaucgautt

SEQ ID NO: 371 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
aucgauugcuaagcagcagtt

SEQ ID NO: 372 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
cacgguggaugcuccauuutt

SEQ ID NO: 373 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
aaauggagcauccaccgugtt

SEQ ID NO: 374 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
gguuuacgacccguacuuutt

SEQ ID NO: 375 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
aaaguacgggucguaaacctt

SEQ ID NO: 376 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
cccaacuuacaugauucgutt

SEQ ID NO: 377 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
acgaaucauguaaguugggtt

SEQ ID NO: 378 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
guucaucguccauaacaaatt

SEQ ID NO: 379 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
uuuguuauggacgaugaactt

SEQ ID NO: 380 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
cucacuugagucgucuugatt

SEQ ID NO: 381 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
ucaagacgacucaagugagtt

SEQ ID NO: 382 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
ccucccgaacucuguacgatt

SEQ ID NO: 383 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
ucguacagaguucgggaggtt

SEQ ID NO: 384 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
cuguacgaaacaccuauuutt

SEQ ID NO: 385 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
aaauagguguuucguacagtt

SEQ ID NO: 386 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
cgaaacaccuauuuuacgatt

SEQ ID NO: 387 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
ucguaaaauagguguuucgtt

SEQ ID NO: 388 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
gaaacaccuauuuuacgaatt

SEQ ID NO: 389 - DNA, 21 bp, Artificial Sequence
  Description of Artificial Sequence: Synthetic EGLN3 iRNA agent oligonucleotide
  Description of Combined DNA/RNA Molecule: Synthetic EGLN3 iRNA agent oligonucleotide
uucguaaaauagguguuuctt

SEQ ID NO: 390 - DNA, 7102 bp, Homo sapiens
ttaggggcagaaaaacatttgtaataattaatggctttgagagacacaaggctttgtttgccccagagtattagttaacccacctagtgctcctaatcatacaatattaaggattgggagggacattcattgcctcactctctatttgtttcaccttctgtaaaattggtagaataatagtacccacttcatagcattgtatgatgattaaattggttaatatttttaaaatgcttagaacacagattgggcacataacagcaagcaccacatgtgtttataagataaattcctttgtgttgccttccgttaaagtttaaataagtaaataaataaataaatacttgcatgacattttgaagtctctctataacatctgagtaagtggcggctgcgacaatgctactggagttccagaatcgtgttggtgacaagattgttcaccagcatatggtgtggtgaaaactcactaatttggaattagttcagattattaagcctgaataggtgaaaatcctgaaatcaaggatctttggaactatttgaaatcagtattttatattttcctgttgtattcattaaagtgttgcaagtgttctatttgatggattaagtatatttaggatatacatgttcaatttgtgattttgtatacttaattggaacaagaaagctaataaaggttttgatatggacatctattcttttaagtaaacttcaatgaaaatatatgagtagagcatatagagatgtaaataatttgtggacacaccacagactgaaatagcaaatttaaaagaaattgttggaagaatcaagtgtttgtggaatgagtcctcctagtaaagttcctgctcttgtgaataattaagcctcatgtataattactatagcaaaaggaagcctaagaagtattagactctacttgtatttaaattacattttacataatttatgtgtatgaaaaatgttttaaatgcttattttcgtaagccatgagatagctcctttatattttaagaatttctgaattaatttgcttggattttattagtgcaaatggcagagctagcaattcctttttctgtgttcccattccatcctattcatccctcttttaggaaactctgaactctggattgtccttgtttacatacctgcctcctgcattggactatgtgtctctgagtgtagtatgactaattcatttgtttgtcaaggactctcaatgcatttgttgaacagcctaattagtaatgtctgcaacaatgacattttactgtatttaataaagctctgggaaagtaggatacacataagacaggtctaggtctaaattctttacagaaacttggatttttagttcggtttgaaatttgaagatgtgagtatatttatctcagtttcccaaaggacaagctaattggaattatcatcctctttcacttgattggatccccagaatgccatttacgcatgcagcaggattttataacagttttaaattctgtatatttgatgaagaggttttatatttttggattcaagcctctttttaaacttctacaatatggtttacaataattccttatatcctgcttttgaaatacatattacaactttttaagtttggaaggctatatttcaaggactgaagttacagtatactcaagtgatacacaagcctagcaccccactttccacatagtgttcgataaagattgataaactcgaaatcacagaccttttaattcttaagacaaatagcagcagaaagaaacatctttggcttatttctggtaaggtttttatgctctgtaaaacaaagaattgtattcatccgcgcagcacagattctattaaaaataaatgtgagagtcgttaatgtagtactgctcatttaccatcaaaattcacttttcaggaataatcccatcagtttaaattggatattggaatgagcattgattacatttaacttggtagcccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacattaaaaaa

SEQ ID NO: 391 - DNA, 2111 bp, Homo sapiens
gctttcccctgcctgcctgtctctagtttctctcacatccctttttttttttcctttctctagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcaaaaaaaaaaaaaaaaaaaaaaa

SEQ ID NO: 392 - DNA, 2722 bp, Homo sapiens
gagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagccccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgttttttttttttttttttttttagttttcctttttaatgagctcaccctttaacacaaaaaaagcaaggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttattcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcctacattagcattctaa

SEQ ID NO: 393 - RNA, 19 nt, Artificial Sequence
  Description of Artificial Sequence: Synthetic iRNA agent targeting human EGLN1 oligonucleotide
agagacacaaggcuuuguu

SEQ ID NO: 394 - RNA, 19 nt, Artificial Sequence
  Description of Artificial Sequence: Synthetic iRNA agent targeting human EGLN1 oligonucleotide
aacaaagccuugugucucu

SEQ ID NO: 395 - RNA, 19 nt, Artificial Sequence
  Description of Artificial Sequence: Synthetic iRNA agent targeting human EGLN1 oligonucleotide
uguuugccccagaguauua

SEQ ID NO: 396 - RNA, 19 nt, Artificial Sequence
  Description of Artificial Sequence: Synthetic iRNA agent targeting human EGLN1 oligonucleotide
uaauacucuggggcaaaca

SEQ ID NO: 397 - RNA, 19 nt, Artificial Sequence
  Description of Artificial Sequence: Synthetic iRNA agent targeting human EGLN1 oligonucleotide
ugccccagaguauuaguua

SEQ ID NO: 398 - RNA, 19 nt, Artificial Sequence
  Description of Artificial Sequence: Synthetic iRNA agent targeting human EGLN1 oligonucleotide
uaacuaauacucuggggca

SEQ ID NO: 399 - RNA, 19 nt, Artificial Sequence
  Description of Artificial Sequence: Synthetic iRNA agent targeting human EGLN1 oligonucleotide
gccccagaguauuaguuaa

SEQ ID NO: 400 - RNA, 19 nt, Artificial Sequence
  Description of Artificial Sequence: Synthetic iRNA agent targeting human EGLN1 oligonucleotide
uuaacuaauacucuggggc

SEQ ID NO: 401 - RNA, 19 nt, Artificial Sequence
  Description of Artificial Sequence: Synthetic iRNA agent targeting human EGLN1 oligonucleotide
cagaguauuaguuaaccca

SEQ ID NO: 402 - RNA, 19 nt, Artificial Sequence
  Description of Artificial Sequence: Synthetic iRNA agent targeting human EGLN1 oligonucleotide
uggguuaacuaauacucug

SEQ ID NO: 403 - RNA, 19 nt, Artificial Sequence
  Description of Artificial Sequence: Synthetic iRNA agent targeting human EGLN1 oligonucleotide
auuaguuaacccaccuagu

SEQ ID NO: 404 - RNA, 19 nt, Artificial Sequence
  Description of Artificial Sequence: Synthetic iRNA agent targeting human EGLN1 oligonucleotide
acuagguggguuaacuaau

SEQ ID NO: 405 - RNA, 19 nt, Artificial Sequence
  Description of Artificial Sequence: Synthetic iRNA agent targeting human EGLN1 oligonucleotide
aguuaacccaccuagugcu

SEQ ID NO: 406 - RNA, 19 nt, Artificial Sequence
  Description of Artificial Sequence: Synthetic iRNA agent targeting human EGLN1 oligonucleotide
agcacuagguggguuaacu

SEQ ID NO: 407 - RNA, 19 nt, Artificial Sequence
  Description of Artificial Sequence: Synthetic iRNA agent targeting human EGLN1 oligonucleotide
aacccaccuagugcuccua

SEQ ID NO: 408 - RNA, 19 nt, Artificial Sequence
  Description of Artificial Sequence: Synthetic iRNA agent targeting human EGLN1 oligonucleotide
uaggagcacuagguggguu

SEQ ID NO: 409 - RNA, 19 nt, Artificial Sequence
  Description of Artificial Sequence: Synthetic iRNA agent targeting human EGLN1 oligonucleotide
cccaccuagugcuccuaau

SEQ ID NO: 410 - RNA, 19 nt, Artificial Sequence
  Description of Artificial Sequence: Synthetic iRNA agent targeting human EGLN1 oligonucleotide
auuaggagcacuagguggg

SEQ ID NO: 411 - RNA, 19 nt, Artificial Sequence
  Description of Artificial Sequence: Synthetic iRNA agent targeting human EGLN1 oligonucleotide
agugcuccuaaucauacaa

SEQ ID NO: 412 - RNA, 19 nt, Artificial Sequence
  Description of Artificial Sequence: Synthetic iRNA agent targeting human EGLN1 oligonucleotide
uuguaugauuaggagcacu

SEQ ID NO: 413 - RNA, 19 nt, Artificial Sequence
  Description of Artificial Sequence: Synthetic iRNA agent targeting human EGLN1 oligonucleotide
gccucacucucuauuuguu

SEQ ID NO: 414 - RNA, 19 nt, Artificial Sequence
  Description of Artificial Sequence: Synthetic iRNA agent targeting human EGLN1 oligonucleotide
aacaaauagagagugaggc

SEQ ID NO: 415 - RNA, 19 nt, Artificial Sequence
  Description of Artificial Sequence: Synthetic iRNA agent targeting human EGLN1 oligonucleotide
accuucuguaaaauuggua

SEQ ID NO: 416 - RNA, 19 nt, Artificial Sequence
  Description of Artificial Sequence: Synthetic iRNA agent targeting human EGLN1 oligonucleotide
uaccaauuuuacagaaggu

SEQ ID NO: 417 - RNA, 19 nt, Artificial Sequence
  Description of Artificial Sequence: Synthetic iRNA agent targeting human EGLN1 oligonucleotide
gguagaauaauaguaccca

SEQ ID NO: 418 - RNA, 19 nt, Artificial Sequence
  Description of Artificial Sequence: Synthetic iRNA agent targeting human EGLN1 oligonucleotide
uggguacuauuauucuacc

SEQ ID NO: 419 - RNA, 19 nt, Artificial Sequence
  Description of Artificial Sequence: Synthetic iRNA agent targeting human EGLN1 oligonucleotide
uagaauaauaguacccacu

SEQ ID NO: 420 - RNA, 19 nt, Artificial Sequence
  Description of Artificial Sequence: Synthetic iRNA agent targeting human EGLN1 oligonucleotide
aguggguacuauuauucua

SEQ ID NO: 421 - RNA, 19 nt, Artificial Sequence
  Description of Artificial Sequence: Synthetic iRNA agent targeting human EGLN1 oligonucleotide
agaauaauaguacccacuu

SEQ ID NO: 422 - RNA, 19 nt, Artificial Sequence
  Description of Artificial Sequence: Synthetic iRNA agent targeting human EGLN1 oligonucleotide
aaguggguacuauuauucu

SEQ ID NO: 423 - RNA, 19 nt, Artificial Sequence
  Description of Artificial Sequence: Synthetic iRNA agent targeting human EGLN1 oligonucleotide
aguacccacuucauagcau

SEQ ID NO: 424 - RNA, 19 nt, Artificial Sequence
  Description of Artificial Sequence: Synthetic iRNA agent targeting human EGLN1 oligonucleotide
augcuaugaaguggguacu

SEQ ID NO: 425 - RNA, 19 nt, Artificial Sequence
  Description of Artificial Sequence: Synthetic iRNA agent targeting human EGLN1 oligonucleotide
augaugauuaaauugguua

SEQ ID NO: 426 - RNA, 19 nt, Artificial Sequence
  Description of Artificial Sequence: Synthetic iRNA agent targeting human EGLN1 oligonucleotide
uaaccaauuuaaucaucau

SEQ ID NO: 427 - RNA, 19 nt, Artificial Sequence
  Description of Artificial Sequence: Synthetic iRNA agent targeting human EGLN1 oligonucleotide
uuagaacacagauugggca

SEQ ID NO: 428 - RNA, 19 nt, Artificial Sequence
  Description of Artificial Sequence: Synthetic iRNA agent targeting human EGLN1 oligonucleotide
ugcccaaucuguguucuaa

SEQ ID NO: 429 - RNA, 19 nt, Artificial Sequence
  Description of Artificial Sequence: Synthetic iRNA agent targeting human EGLN1 oligonucleotide
gauugggcacauaacagca

SEQ ID NO: 430 - RNA, 19 nt, Artificial Sequence
  Description of Artificial Sequence: Synthetic iRNA agent targeting human EGLN1 oligonucleotide
ugcuguuaugugcccaauc

SEQ ID NO: 431 - RNA, 19 nt, Artificial Sequence
  Description of Artificial Sequence: Synthetic iRNA agent targeting human EGLN1 oligonucleotide
gggcacauaacagcaagca

SEQ ID NO: 432 - RNA, 19 nt, Artificial Sequence
  Description of Artificial Sequence: Synthetic iRNA agent targeting human EGLN1 oligonucleotide
ugcuugcuguuaugugccc

SEQ ID NO: 433 - RNA, 19 nt, Artificial Sequence
  Description of Artificial Sequence: Synthetic iRNA agent targeting human EGLN1 oligonucleotide
auaacagcaagcaccacau

SEQ ID NO: 434 - RNA, 19 nt, Artificial Sequence
  Description of Artificial Sequence: Synthetic iRNA agent targeting human EGLN1 oligonucleotide
auguggugcuugcuguuau

SEQ ID NO: 435 - RNA, 19 nt, Artificial Sequence
  Description of Artificial Sequence: Synthetic iRNA agent targeting human EGLN1 oligonucleotide
aaauuccuuuguguugccu

SEQ ID NO: 436 - RNA, 19 nt, Artificial Sequence
  Description of Artificial Sequence: Synthetic iRNA agent targeting human EGLN1 oligonucleotide
aggcaacacaaaggaauuu

SEQ ID NO: 437 - RNA, 19 nt, Artificial Sequence
  Description of Artificial Sequence: Synthetic iRNA agent targeting human EGLN1 oligonucleotide
ccuuuguguugccuuccgu

SEQ ID NO: 438 - RNA, 19 nt, Artificial Sequence
  Description of Artificial Sequence: Synthetic iRNA agent targeting human EGLN1 oligonucleotide
acggaaggcaacacaaagg

SEQ ID NO: 439 - RNA, 19 nt, Artificial Sequence
  Description of Artificial Sequence: Synthetic iRNA agent targeting human EGLN1 oligonucleotide
cuuuguguugccuuccguu

SEQ ID NO: 440 - RNA, 19 nt, Artificial Sequence
  Description of Artificial Sequence: Synthetic iRNA agent targeting human EGLN1 oligonucleotide
aacggaaggcaacacaaag

SEQ ID NO: 441 - RNA, 19 nt, Artificial Sequence
  Description of Artificial Sequence: Synthetic iRNA agent targeting human EGLN1 oligonucleotide
uuguguugccuuccguuaa

SEQ ID NO: 442 - RNA, 19 nt, Artificial Sequence
  Description of Artificial Sequence: Synthetic iRNA agent targeting human EGLN1 oligonucleotide
uuaacggaaggcaacacaa

SEQ ID NO: 443 - RNA, 19 nt, Artificial Sequence
  Description of Artificial Sequence: Synthetic iRNA agent targeting human EGLN1 oligonucleotide
uguguugccuuccguuaaa

SEQ ID NO: 444 - RNA, 19 nt, Artificial Sequence
  Description of Artificial Sequence: Synthetic iRNA agent targeting human EGLN1 oligonucleotide
uuuaacggaaggcaacaca

SEQ ID NO: 445 - RNA, 19 nt, Artificial Sequence
  Description of Artificial Sequence: Synthetic iRNA agent targeting human EGLN1 oligonucleotide
uguugccuuccguuaaagu

SEQ ID NO: 446 - RNA, 19 nt, Artificial Sequence
  Description of Artificial Sequence: Synthetic iRNA agent targeting human EGLN1 oligonucleotide
acuuuaacggaaggcaaca

SEQ ID NO: 447 - RNA, 19 nt, Artificial Sequence
  Description of Artificial Sequence: Synthetic iRNA agent targeting human EGLN1 oligonucleotide
guugccuuccguuaaaguu

SEQ ID NO: 448 - RNA, 19 nt, Artificial Sequence
  Description of Artificial Sequence: Synthetic iRNA agent targeting human EGLN1 oligonucleotide
aacuuuaacggaaggcaac

SEQ ID NO: 449 - RNA, 19 nt, Artificial Sequence
  Description of Artificial Sequence: Synthetic iRNA agent targeting human EGLN1 oligonucleotide
aauaaauacuugcaugaca

SEQ ID NO: 450 - RNA, 19 nt, Artificial Sequence
  Description of Artificial Sequence: Synthetic iRNA agent targeting human EGLN1 oligonucleotide
ugucaugcaaguauuuauu

SEQ ID NO: 451 - RNA, 19 nt, Artificial Sequence
  Description of Artificial Sequence: Synthetic iRNA agent targeting human EGLN1 oligonucleotide
aagucucucuauaacaucu

SEQ ID NO: 452 - RNA, 19 nt, Artificial Sequence
  Description of Artificial Sequence: Synthetic iRNA agent targeting human EGLN1 oligonucleotide
agauguuauagagagacuu

SEQ ID NO: 453 - RNA, 19 nt, Artificial Sequence
  Description of Artificial Sequence: Synthetic iRNA agent targeting human EGLN1 oligonucleotide
cuauaacaucugaguaagu

SEQ ID NO: 454 - RNA, 19 nt, Artificial Sequence
  Description of Artificial Sequence: Synthetic iRNA agent targeting human EGLN1 oligonucleotide
acuuacucagauguuauag

SEQ ID NO: 455 - RNA, 19 nt, Artificial Sequence
  Description of Artificial Sequence: Synthetic iRNA agent targeting human EGLN1 oligonucleotide
aucugaguaaguggcggcu

SEQ ID NO: 456 - RNA, 19 nt, Artificial Sequence
  Description of Artificial Sequence: Synthetic iRNA agent targeting human EGLN1 oligonucleotide
agccgccacuuacucagau

SEQ ID NO: 457 - RNA, 19 nt, Artificial Sequence
  Description of Artificial Sequence: Synthetic iRNA agent targeting human EGLN1 oligonucleotide
cggcugcgacaaugcuacu

SEQ ID NO: 458 - RNA, 19 nt, Artificial Sequence
  Description of Artificial Sequence: Synthetic iRNA agent targeting human EGLN1 oligonucleotide
aguagcauugucgcagccg

SEQ ID NO: 459 - RNA, 19 nt, Artificial Sequence
  Description of Artificial Sequence: Synthetic iRNA agent targeting human EGLN1 oligonucleotide
gcgacaaugcuacuggagu

SEQ ID NO: 460 - RNA, 19 nt, Artificial Sequence
  Description of Artificial Sequence: Synthetic iRNA agent targeting human EGLN1 oligonucleotide
acuccaguagcauugucgc

SEQ ID NO: 461 - RNA, 19 nt, Artificial Sequence
  Description of Artificial Sequence: Synthetic iRNA agent targeting human EGLN1 oligonucleotide
cgacaaugcuacuggaguu

SEQ ID NO: 462 - RNA, 19 nt, Artificial Sequence
  Description of Artificial Sequence: Synthetic iRNA agent targeting human EGLN1 oligonucleotide
aacuccaguagcauugucg

SEQ ID NO: 463 - RNA, 19 nt, Artificial Sequence
  Description of Artificial Sequence: Synthetic iRNA agent targeting human EGLN1 oligonucleotide
guuccagaaucguguuggu

SEQ ID NO: 464 - RNA, 19 nt, Artificial Sequence
  Description of Artificial Sequence: Synthetic iRNA agent targeting human EGLN1 oligonucleotide
accaacacgauucuggaac

SEQ ID NO: 465 - RNA, 19 nt, Artificial Sequence
  Description of Artificial Sequence: Synthetic iRNA agent targeting human EGLN1 oligonucleotide
gugacaagauuguucacca

SEQ ID NO: 466 - RNA, 19 nt, Artificial Sequence
  Description of Artificial Sequence: Synthetic iRNA agent targeting human EGLN1 oligonucleotide
uggugaacaaucuugucac

SEQ ID NO: 467 - RNA, 19 nt, Artificial Sequence
  Description of Artificial Sequence: Synthetic iRNA agent targeting human EGLN1 oligonucleotide
agauuguucaccagcauau

SEQ ID NO: 468 - RNA, 19 nt, Artificial Sequence
  Description of Artificial Sequence: Synthetic iRNA agent targeting human EGLN1 oligonucleotide
auaugcuggugaacaaucu

SEQ ID NO: 469 - RNA, 19 nt, Artificial Sequence
  Description of Artificial Sequence: Synthetic iRNA agent targeting human EGLN1 oligonucleotide
guucaccagcauauggugu

SEQ ID NO: 470 - RNA, 19 nt, Artificial Sequence
  Description of Artificial Sequence: Synthetic iRNA agent targeting human EGLN1 oligonucleotide
acaccauaugcuggugaac

SEQ ID NO: 471 - RNA, 19 nt, Artificial Sequence
  Description of Artificial Sequence: Synthetic iRNA agent targeting human EGLN1 oligonucleotide
ccagcauauggugugguga

SEQ ID NO: 472 - RNA, 19 nt, Artificial Sequence
  Description of Artificial Sequence: Synthetic iRNA agent targeting human EGLN1 oligonucleotide
ucaccacaccauaugcugg

SEQ ID NO: 473 - RNA, 19 nt, Artificial Sequence
  Description of Artificial Sequence: Synthetic iRNA agent targeting human EGLN1 oligonucleotide
gguguggugaaaacucacu

SEQ ID NO: 474 - RNA, 19 nt, Artificial Sequence
  Description of Artificial Sequence: Synthetic iRNA agent targeting human EGLN1 oligonucleotide
agugaguuuucaccacacc

SEQ ID NO: 475 - RNA, 19 nt, Artificial Sequence
  Description of Artificial Sequence: Synthetic iRNA agent targeting human EGLN1 oligonucleotide
uguggugaaaacucacuaa

SEQ ID NO: 476 - RNA, 19 nt, Artificial Sequence
  Description of Artificial Sequence: Synthetic iRNA agent targeting human EGLN1 oligonucleotide
uuagugaguuuucaccaca

SEQ ID NO: 477 - RNA, 19 nt, Artificial Sequence
  Description of Artificial Sequence: Synthetic iRNA agent targeting human EGLN1 oligonucleotide
uggugaaaacucacuaauu

SEQ ID NO: 478 - RNA, 19 nt, Artificial Sequence
  Description of Artificial Sequence: Synthetic iRNA agent targeting human EGLN1 oligonucleotide
aauuagugaguuuucacca

SEQ ID NO: 479 - RNA, 19 nt, Artificial Sequence
  Description of Artificial Sequence: Synthetic iRNA agent targeting human EGLN1 oligonucleotide
ggugaaaacucacuaauuu

SEQ ID NO: 480 - RNA, 19 nt, Artificial Sequence
  Description of Artificial Sequence: Synthetic iRNA agent targeting human EGLN1 oligonucleotide
aaauuagugaguuuucacc

SEQ ID NO: 481 - RNA, 19 nt, Artificial Sequence
  Description of Artificial Sequence: Synthetic iRNA agent targeting human EGLN1 oligonucleotide
agauuauuaagccugaaua

SEQ ID NO: 482 - RNA, 19 nt, Artificial Sequence
  Description of Artificial Sequence: Synthetic iRNA agent targeting human EGLN1 oligonucleotide
uauucaggcuuaauaaucu

SEQ ID NO: 483 - RNA, 19 nt, Artificial Sequence
  Description of Artificial Sequence: Synthetic iRNA agent targeting human EGLN1 oligonucleotide
uuauuaagccugaauaggu

SEQ ID NO: 484 - RNA, 19 nt, Artificial Sequence
  Description of Artificial Sequence: Synthetic iRNA agent targeting human EGLN1 oligonucleotide
accuauucaggcuuaauaa

SEQ ID NO: 485 - RNA, 19 nt, Artificial Sequence
  Description of Artificial Sequence: Synthetic iRNA agent targeting human EGLN1 oligonucleotide
auuaagccugaauagguga

SEQ ID NO: 486 - RNA, 19 nt, Artificial Sequence
  Description of Artificial Sequence: Synthetic iRNA agent targeting human EGLN1 oligonucleotide
ucaccuauucaggcuuaau

SEQ ID NO: 487 - RNA, 19 nt, Artificial Sequence
  Description of Artificial Sequence: Synthetic iRNA agent targeting human EGLN1 oligonucleotide
uuaagccugaauaggugaa

SEQ ID NO: 488 - RNA, 19 nt, Artificial Sequence
  Description of Artificial Sequence: Synthetic iRNA agent targeting human EGLN1 oligonucleotide
uucaccuauucaggcuuaa

SEQ ID NO: 489 - RNA, 19 nt, Artificial Sequence
  Description of Artificial Sequence: Synthetic iRNA agent targeting human EGLN1 oligonucleotide
uaagccugaauaggugaaa

SEQ ID NO: 490 - RNA, 19 nt, Artificial Sequence
  Description of Artificial Sequence: Synthetic iRNA agent targeting human EGLN1 oligonucleotide
uuucaccuauucaggcuua

SEQ ID NO: 491 - RNA, 19 nt, Artificial Sequence
  Description of Artificial Sequence: Synthetic iRNA agent targeting human EGLN1 oligonucleotide
gaaaucaaggaucuuugga

SEQ ID NO: 492 - RNA, 19 nt, Artificial Sequence
  Description of Artificial Sequence: Synthetic iRNA agent targeting human EGLN1 oligonucleotide
uccaaagauccuugauuuc

SEQ ID NO: 493 - RNA, 19 nt, Artificial Sequence
  Description of Artificial Sequence: Synthetic iRNA agent targeting human EGLN1 oligonucleotide
uuaaaguguugcaaguguu

SEQ ID NO: 494 - RNA, 19 nt, Artificial Sequence
  Description of Artificial Sequence: Synthetic iRNA agent targeting human EGLN1 oligonucleotide
aacacuugcaacacuuuaa

SEQ ID NO: 495 - RNA, 19 nt, Artificial Sequence
  Description of Artificial Sequence: Synthetic iRNA agent targeting human EGLN1 oligonucleotide
ucuauuugauggauuaagu

SEQ ID NO: 496 - RNA, 19 nt, Artificial Sequence
  Description of Artificial Sequence: Synthetic iRNA agent targeting human EGLN1 oligonucleotide
acuuaauccaucaaauaga

SEQ ID NO: 497 - RNA, 19 nt, Artificial Sequence
  Description of Artificial Sequence: Synthetic iRNA agent targeting human EGLN1 oligonucleotide
cuauuugauggauuaagua

SEQ ID NO: 498 - RNA, 19 nt, Artificial Sequence
  Description of Artificial Sequence: Synthetic iRNA agent targeting human EGLN1 oligonucleotide
uacuuaauccaucaaauag

SEQ ID NO: 499 - RNA, 19 nt, Artificial Sequence
  Description of Artificial Sequence: Synthetic iRNA agent targeting human EGLN1 oligonucleotide
uauuugauggauuaaguau

SEQ ID NO: 500 - RNA, 19 nt, Artificial Sequence
  Description of Artificial Sequence: Synthetic iRNA agent targeting human EGLN1 oligonucleotide
auacuuaauccaucaaaua

SEQ ID NO: 501 - RNA, 19 nt, Artificial Sequence
  Description of Artificial Sequence: Synthetic iRNA agent targeting human EGLN1 oligonucleotide
auuugauggauuaaguaua

SEQ ID NO: 502 - RNA, 19 nt, Artificial Sequence
  Description of Artificial Sequence: Synthetic iRNA agent targeting human EGLN1 oligonucleotide
uauacuuaauccaucaaau

SEQ ID NO: 503 - RNA, 19 nt, Artificial Sequence
  Description of Artificial Sequence: Synthetic iRNA agent targeting human EGLN1 oligonucleotide
uuugauggauuaaguauau

SEQ ID NO: 504 - RNA, 19 nt, Artificial Sequence
  Description of Artificial Sequence: Synthetic iRNA agent targeting human EGLN1 oligonucleotide
auauacuuaauccaucaaa

SEQ ID NO: 505 - RNA, 19 nt, Artificial Sequence
  Description of Artificial Sequence: Synthetic iRNA agent targeting human EGLN1 oligonucleotide
uuaaguauauuuaggauau

SEQ ID NO: 506 - RNA, 19 nt, Artificial Sequence
  Description of Artificial Sequence: Synthetic iRNA agent targeting human EGLN1 oligonucleotide
auauccuaaauauacuuaa

SEQ ID NO: 507 - RNA, 19 nt, Artificial Sequence
  Description of Artificial Sequence: Synthetic iRNA agent targeting human EGLN1 oligonucleotide
uaaguauauuuaggauaua

SEQ ID NO: 508 - RNA, 19 nt, Artificial Sequence
  Description of Artificial Sequence: Synthetic iRNA agent targeting human EGLN1 oligonucleotide
uauauccuaaauauacuua

SEQ ID NO: 509 - RNA, 19 nt, Artificial Sequence
  Description of Artificial Sequence: Synthetic iRNA agent targeting human EGLN1 oligonucleotide
ugauauggacaucuauucu

SEQ ID NO: 510 - RNA, 19 nt, Artificial Sequence
  Description of Artificial Sequence: Synthetic iRNA agent targeting human EGLN1 oligonucleotide
agaauagauguccauauca

SEQ ID NO: 511 - RNA, 19 nt, Artificial Sequence
  Description of Artificial Sequence: Synthetic iRNA agent targeting human EGLN1 oligonucleotide
gauauggacaucuauucuu

SEQ ID NO: 512 - RNA, 19 nt, Artificial Sequence
  Description of Artificial Sequence: Synthetic iRNA agent targeting human EGLN1 oligonucleotide
aagaauagauguccauauc

SEQ ID NO: 513 - RNA, 19 nt, Artificial Sequence
  Description of Artificial Sequence: Synthetic iRNA agent targeting human EGLN1 oligonucleotide
uuuaaguaaacuucaauga

SEQ ID NO: 514 - RNA, 19 nt, Artificial Sequence
  Description of Artificial Sequence: Synthetic iRNA agent targeting human EGLN1 oligonucleotide
ucauugaaguuuacuuaaa

SEQ ID NO: 515 - RNA, 19 nt, Artificial Sequence
  Description of Artificial Sequence: Synthetic iRNA agent targeting human EGLN1 oligonucleotide
augaaaauauaugaguaga

SEQ ID NO: 516 - RNA, 19 nt, Artificial Sequence
  Description of Artificial Sequence: Synthetic iRNA agent targeting human EGLN1 oligonucleotide
ucuacucauauauuuucau

SEQ ID NO: 517 - RNA, 19 nt, Artificial Sequence
  Description of Artificial Sequence: Synthetic iRNA agent targeting human EGLN1 oligonucleotide
aaaauauaugaguagagca

SEQ ID NO: 518 - RNA, 19 nt, Artificial Sequence
  Description of Artificial Sequence: Synthetic iRNA agent targeting human EGLN1 oligonucleotide
ugcucuacucauauauuuu

SEQ ID NO: 519 - RNA, 19 nt, Artificial Sequence
  Description of Artificial Sequence: Synthetic iRNA agent targeting human EGLN1 oligonucleotide
aaauauaugaguagagcau

SEQ ID NO: 520 - RNA, 19 nt, Artificial Sequence
  Description of Artificial Sequence: Synthetic iRNA agent targeting human EGLN1 oligonucleotide
augcucuacucauauauuu

SEQ ID NO: 521 - RNA, 19 nt, Artificial Sequence
  Description of Artificial Sequence: Synthetic iRNA agent targeting human EGLN1 oligonucleotide
aauauaugaguagagcaua

SEQ ID NO: 522 - RNA, 19 nt, Artificial Sequence
  Description of Artificial Sequence: Synthetic iRNA agent targeting human EGLN1 oligonucleotide
uaugcucuacucauauauu

SEQ ID NO: 523 - RNA, 19 nt, Artificial Sequence
  Description of Artificial Sequence: Synthetic iRNA agent targeting human EGLN1 oligonucleotide
auauaugaguagagcauau

SEQ ID NO: 524 - RNA, 19 nt, Artificial Sequence
  Description of Artificial Sequence: Synthetic iRNA agent targeting human EGLN1 oligonucleotide
auaugcucuacucauauau

SEQ ID NO: 525 - RNA, 19 nt, Artificial Sequence
  Description of Artificial Sequence: Synthetic iRNA agent targeting human EGLN1 oligonucleotide
uauaugaguagagcauaua

SEQ ID NO: 526 - RNA, 19 nt, Artificial Sequence
  Description of Artificial Sequence: Synthetic iRNA agent targeting human EGLN1 oligonucleotide
uauaugcucuacucauaua

SEQ ID NO: 527 - RNA, 19 nt, Artificial Sequence
  Description of Artificial Sequence: Synthetic iRNA agent targeting human EGLN1 oligonucleotide
uaugaguagagcauauaga

SEQ ID NO: 528 - RNA, 19 nt, Artificial Sequence
  Description of Artificial Sequence: Synthetic iRNA agent targeting human EGLN1 oligonucleotide
ucuauaugcucuacucaua

SEQ ID NO: 529 - RNA, 19 nt, Artificial Sequence
  Description of Artificial Sequence: Synthetic iRNA agent targeting human EGLN1 oligonucleotide
accacagacugaaauagca

SEQ ID NO: 530 - RNA, 19 nt, Artificial Sequence
  Description of Artificial Sequence: Synthetic iRNA agent targeting human EGLN1 oligonucleotide
ugcuauuucagucuguggu

SEQ ID NO: 531 - RNA, 19 nt, Artificial Sequence
  Description of Artificial Sequence: Synthetic iRNA agent targeting human EGLN1 oligonucleotide
ggaaugaguccuccuagua

SEQ ID NO: 532 - RNA, 19 nt, Artificial Sequence
  Description of Artificial Sequence: Synthetic iRNA agent targeting human EGLN1 oligonucleotide
uacuaggaggacucauucc

SEQ ID NO: 533 - RNA, 19 nt, Artificial Sequence
  Description of Artificial Sequence: Synthetic iRNA agent targeting human EGLN1 oligonucleotide
gaaugaguccuccuaguaa

SEQ ID NO: 534 - RNA, 19 nt, Artificial Sequence
  Description of Artificial Sequence: Synthetic iRNA agent targeting human EGLN1 oligonucleotide
uuacuaggaggacucauuc

SEQ ID NO: 535 - RNA, 19 nt, Artificial Sequence
  Description of Artificial Sequence: Synthetic iRNA agent targeting human EGLN1 oligonucleotide
aaugaguccuccuaguaaa

SEQ ID NO: 536 - RNA, 19 nt, Artificial Sequence
  Description of Artificial Sequence: Synthetic iRNA agent targeting human EGLN1 oligonucleotide
uuuacuaggaggacucauu

SEQ ID NO: 537 - RNA, 19 nt, Artificial Sequence
  Description of Artificial Sequence: Synthetic iRNA agent targeting human EGLN1 oligonucleotide
gaguccuccuaguaaaguu

SEQ ID NO: 538 - RNA, 19 nt, Artificial Sequence
  Description of Artificial Sequence: Synthetic iRNA agent targeting human EGLN1 oligonucleotide
aacuuuacuaggaggacuc

SEQ ID NO: 539 - RNA, 19 nt, Artificial Sequence
  Description of Artificial Sequence: Synthetic iRNA agent targeting human EGLN1 oligonucleotide
uuccugcucuugugaauaa

SEQ ID NO: 540 - RNA, 19 nt, Artificial Sequence
  Description of Artificial Sequence: Synthetic iRNA agent targeting human EGLN1 oligonucleotide
uuauucacaagagcaggaa

SEQ ID NO: 541 - RNA, 19 nt, Artificial Sequence
  Description of Artificial Sequence: Synthetic iRNA agent targeting human EGLN1 oligonucleotide
ugugaauaauuaagccuca

SEQ ID NO: 542 - RNA, 19 nt, Artificial Sequence
  Description of Artificial Sequence: Synthetic iRNA agent targeting human EGLN1 oligonucleotide
ugaggcuuaauuauucaca

SEQ ID NO: 543 - RNA, 19 nt, Artificial Sequence
  Description of Artificial Sequence: Synthetic iRNA agent targeting human EGLN1 oligonucleotide
uuaagccucauguauaauu

SEQ ID NO: 544 - RNA, 19 nt, Artificial Sequence
  Description of Artificial Sequence: Synthetic iRNA agent targeting human EGLN1 oligonucleotide
aauuauacaugaggcuuaa

SEQ ID NO: 545 - RNA, 19 nt, Artificial Sequence
  Description of Artificial Sequence: Synthetic iRNA agent targeting human EGLN1 oligonucleotide
gccucauguauaauuacua

SEQ ID NO: 546 - RNA, 19 nt, Artificial Sequence
  Description of Artificial Sequence: Synthetic iRNA agent targeting human EGLN1 oligonucleotide
uaguaauuauacaugaggc

SEQ ID NO: 547 - RNA, 19 nt, Artificial Sequence
  Description of Artificial Sequence: Synthetic iRNA agent targeting human EGLN1 oligonucleotide
aagccuaagaaguauuaga

SEQ ID NO: 548 - RNA, 19 nt, Artificial Sequence
  Description of Artificial Sequence: Synthetic iRNA agent targeting human EGLN1 oligonucleotide
ucuaauacuucuuaggcuu

SEQ ID NO: 549 - RNA, 19 nt, Artificial Sequence
  Description of Artificial Sequence: Synthetic iRNA agent targeting human EGLN1 oligonucleotide
gccuaagaaguauuagacu

SEQ ID NO: 550 - RNA, 19 nt, Artificial Sequence
  Description of Artificial Sequence: Synthetic iRNA agent targeting human EGLN1 oligonucleotide
agucuaauacuucuuaggc

SEQ ID NO: 551 - RNA, 19 nt, Artificial Sequence
  Description of Artificial Sequence: Synthetic iRNA agent targeting human EGLN1 oligonucleotide
uuaaaugcuuauuuucgua

SEQ ID NO: 552 - RNA, 19 nt, Artificial Sequence
  Description of Artificial Sequence: Synthetic iRNA agent targeting human EGLN1 oligonucleotide
uacgaaaauaagcauuuaa

SEQ ID NO: 553 - RNA, 19 nt, Artificial Sequence
  Description of Artificial Sequence: Synthetic iRNA agent targeting human EGLN1 oligonucleotide
ugcuuauuuucguaagcca

SEQ ID NO: 554 - RNA, 19 nt, Artificial Sequence
  Description of Artificial Sequence: Synthetic iRNA agent targeting human EGLN1 oligonucleotide
uggcuuacgaaaauaagca

SEQ ID NO: 555 - RNA, 19 nt, Artificial Sequence
  Description of Artificial Sequence: Synthetic iRNA agent targeting human EGLN1 oligonucleotide
uuuucguaagccaugagau

SEQ ID NO: 556 - RNA, 19 nt, Artificial Sequence
  Description of Artificial Sequence: Synthetic iRNA agent targeting human EGLN1 oligonucleotide
aucucauggcuuacgaaaa

SEQ ID NO: 557 - RNA, 19 nt, Artificial Sequence
  Description of Artificial Sequence: Synthetic iRNA agent targeting human EGLN1 oligonucleotide
augagauagcuccuuuaua

SEQ ID NO: 558 - RNA, 19 nt, Artificial Sequence
  Description of Artificial Sequence: Synthetic iRNA agent targeting human EGLN1 oligonucleotide
uauaaaggagcuaucucau

SEQ ID NO: 559 - RNA, 19 nt, Artificial Sequence
  Description of Artificial Sequence: Synthetic iRNA agent targeting human EGLN1 oligonucleotide
uggauuuuauuagugcaaa

SEQ ID NO: 560 - RNA, 19 nt, Artificial Sequence
  Description of Artificial Sequence: Synthetic iRNA agent targeting human EGLN1 oligonucleotide
uuugcacuaauaaaaucca

SEQ ID NO: 561 - RNA, 19 nt, Artificial Sequence
  Description of Artificial Sequence: Synthetic iRNA agent targeting human EGLN1 oligonucleotide
ggcagagcuagcaauuccu

SEQ ID NO: 562 - RNA, 19 nt, Artificial Sequence
  Description of Artificial Sequence: Synthetic iRNA agent targeting human EGLN1 oligonucleotide
aggaauugcuagcucugcc

SEQ ID NO: 563 - RNA, 19 nt, Artificial Sequence
  Description of Artificial Sequence: Synthetic iRNA agent targeting human EGLN1 oligonucleotide
auucaucccucuuuuagga

SEQ ID NO: 564 - RNA, 19 nt, Artificial Sequence
  Description of Artificial Sequence: Synthetic iRNA agent targeting human EGLN1 oligonucleotide
uccuaaaagagggaugaau

SEQ ID NO: 565 - RNA, 19 nt, Artificial Sequence
  Description of Artificial Sequence: Synthetic iRNA agent targeting human EGLN1 oligonucleotide
ugccuccugcauuggacua

SEQ ID NO: 566 - RNA, 19 nt, Artificial Sequence
  Description of Artificial Sequence: Synthetic iRNA agent targeting human EGLN1 oligonucleotide
uaguccaaugcaggaggca

SEQ ID NO: 567 - RNA, 19 nt, Artificial Sequence
  Description of Artificial Sequence: Synthetic iRNA agent targeting human EGLN1 oligonucleotide
gccuccugcauuggacuau

SEQ ID NO: 568 - RNA, 19 nt, Artificial Sequence
  Description of Artificial Sequence: Synthetic iRNA agent targeting human EGLN1 oligonucleotide
auaguccaaugcaggaggc

SEQ ID NO: 569 - RNA, 19 nt, Artificial Sequence
  Description of Artificial Sequence: Synthetic iRNA agent targeting human EGLN1 oligonucleotide
cuccugcauuggacuaugu

SEQ ID NO: 570 - RNA, 19 nt, Artificial Sequence
  Description of Artificial Sequence: Synthetic iRNA agent targeting human EGLN1 oligonucleotide
acauaguccaaugcaggag

SEQ ID NO: 571 - RNA, 19 nt, Artificial Sequence
  Description of Artificial Sequence: Synthetic iRNA agent targeting human EGLN1 oligonucleotide
gugucucugaguguaguau

SEQ ID NO: 572 - RNA, 19 nt, Artificial Sequence
  Description of Artificial Sequence: Synthetic iRNA agent targeting human EGLN1 oligonucleotide
auacuacacucagagacac

SEQ ID NO: 573 - RNA, 19 nt, Artificial Sequence
  Description of Artificial Sequence: Synthetic iRNA agent targeting human EGLN1 oligonucleotide
cugaguguaguaugacuaa

SEQ ID NO: 574 - RNA, 19 nt, Artificial Sequence
  Description of Artificial Sequence: Synthetic iRNA agent targeting human EGLN1 oligonucleotide
uuagucauacuacacucag

SEQ ID NO: 575 - RNA, 19 nt, Artificial Sequence
  Description of Artificial Sequence: Synthetic iRNA agent targeting human EGLN1 oligonucleotide
ugaguguaguaugacuaau

SEQ ID NO: 576 - RNA, 19 nt, Artificial Sequence
  Description of Artificial Sequence: Synthetic iRNA agent targeting human EGLN1 oligonucleotide
auuagucauacuacacuca

SEQ ID NO: 577 - RNA, 19 nt, Artificial Sequence
  Description of Artificial Sequence: Synthetic iRNA agent targeting human EGLN1 oligonucleotide
gaguguaguaugacuaauu

SEQ ID NO: 578 - RNA, 19 nt, Artificial Sequence
  Description of Artificial Sequence: Synthetic iRNA agent targeting human EGLN1 oligonucleotide
aauuagucauacuacacuc

SEQ ID NO: 579 - RNA, 19 nt, Artificial Sequence
  Description of Artificial Sequence: Synthetic iRNA agent targeting human EGLN1 oligonucleotide
guguaguaugacuaauuca

SEQ ID NO: 580 - RNA, 19 nt, Artificial Sequence
  Description of Artificial Sequence: Synthetic iRNA agent targeting human EGLN1 oligonucleotide
ugaauuagucauacuacac

SEQ ID NO: 581 - RNA, 19 nt, Artificial Sequence
  Description of Artificial Sequence: Synthetic iRNA agent targeting human EGLN1 oligonucleotide
guuugucaaggacucucaa

SEQ ID NO: 582 - RNA, 19 nt, Artificial Sequence
  Description of Artificial Sequence: Synthetic iRNA agent targeting human EGLN1 oligonucleotide
uugagaguccuugacaaac

SEQ ID NO: 583 - RNA, 19 nt, Artificial Sequence
  Description of Artificial Sequence: Synthetic iRNA agent targeting human EGLN1 oligonucleotide
ucaaggacucucaaugcau

SEQ ID NO: 584 - RNA, 19 nt, Artificial Sequence
  Description of Artificial Sequence: Synthetic iRNA agent targeting human EGLN1 oligonucleotide
augcauugagaguccuuga

SEQ ID NO: 585 - RNA, 19 nt, Artificial Sequence
  Description of Artificial Sequence: Synthetic iRNA agent targeting human EGLN1 oligonucleotide
gacucucaaugcauuuguu

SEQ ID NO: 586 - RNA, 19 nt, Artificial Sequence
  Description of Artificial Sequence: Synthetic iRNA agent targeting human EGLN1 oligonucleotide
aacaaaugcauugagaguc

SEQ ID NO: 587 - RNA, 19 nt, Artificial Sequence
  Description of Artificial Sequence: Synthetic iRNA agent targeting human EGLN1 oligonucleotide
auuuguugaacagccuaau

SEQ ID NO: 588 - RNA, 19 nt, Artificial Sequence
  Description of Artificial Sequence: Synthetic iRNA agent targeting human EGLN1 oligonucleotide
auuaggcuguucaacaaau

SEQ ID NO: 589 - RNA, 19 nt, Artificial Sequence
  Description of Artificial Sequence: Synthetic iRNA agent targeting human EGLN1 oligonucleotide
guugaacagccuaauuagu

SEQ ID NO: 590 - RNA, 19 nt, Artificial Sequence
  Description of Artificial Sequence: Synthetic iRNA agent targeting human EGLN1 oligonucleotide
acuaauuaggcuguucaac

SEQ ID NO: 591 - RNA, 19 nt, Artificial Sequence
  Description of Artificial Sequence: Synthetic iRNA agent targeting human EGLN1 oligonucleotide
uugaacagccuaauuagua

SEQ ID NO: 592 - RNA, 19 nt, Artificial Sequence
  Description of Artificial Sequence: Synthetic iRNA agent targeting human EGLN1 oligonucleotide
uacuaauuaggcuguucaa

SEQ ID NO: 593 - RNA, 19 nt, Artificial Sequence
  Description of Artificial Sequence: Synthetic iRNA agent targeting human EGLN1 oligonucleotide
acagccuaauuaguaaugu

SEQ ID NO: 594 - RNA, 19 nt, Artificial Sequence
  Description of Artificial Sequence: Synthetic iRNA agent targeting human EGLN1 oligonucleotide
acauuacuaauuaggcugu

SEQ ID NO: 595 - RNA, 19 nt, Artificial Sequence
  Description of Artificial Sequence: Synthetic iRNA agent targeting human EGLN1 oligonucleotide
agccuaauuaguaaugucu

SEQ ID NO: 596 - RNA, 19 nt, Artificial Sequence
  Description of Artificial Sequence: Synthetic iRNA agent targeting human EGLN1 oligonucleotide
agacauuacuaauuaggcu

SEQ ID NO: 597 - RNA, 19 nt, Artificial Sequence
  Description of Artificial Sequence: Synthetic iRNA agent targeting human EGLN1 oligonucleotide
guaaugucugcaacaauga

SEQ ID NO: 598 - RNA, 19 nt, Artificial Sequence
  Description of Artificial Sequence: Synthetic iRNA agent targeting human EGLN1 oligonucleotide
ucauuguugcagacauuac

SEQ ID NO: 599 - RNA, 19 nt, Artificial Sequence
  Description of Artificial Sequence: Synthetic iRNA agent targeting human EGLN1 oligonucleotide
uuuaauaaagcucugggaa

SEQ ID NO: 600 - RNA, 19 nt, Artificial Sequence
  Description of Artificial Sequence: Synthetic iRNA agent targeting human EGLN1 oligonucleotide
uucccagagcuuuauuaaa

SEQ ID NO: 601 - RNA, 19 nt, Artificial Sequence
  Description of Artificial Sequence: Synthetic iRNA agent targeting human EGLN1 oligonucleotide
uuaauaaagcucugggaaa

SEQ ID NO: 602 - RNA, 19 nt, Artificial Sequence
  Description of Artificial Sequence: Synthetic iRNA agent targeting human EGLN1 oligonucleotide
uuucccagagcuuuauuaa

SEQ ID NO: 603 - RNA, 19 nt, Artificial Sequence
  Description of Artificial Sequence: Synthetic iRNA agent targeting human EGLN1 oligonucleotide
agcucugggaaaguaggau

SEQ ID NO: 604 - RNA, 19 nt, Artificial Sequence
  Description of Artificial Sequence: Synthetic iRNA agent targeting human EGLN1 oligonucleotide
auccuacuuucccagagcu

SEQ ID NO: 605 - RNA, 19 nt, Artificial Sequence
  Description of Artificial Sequence: Synthetic iRNA agent targeting human EGLN1 oligonucleotide
ucugggaaaguaggauaca

SEQ ID NO: 606 - RNA, 19 nt, Artificial Sequence
  Description of Artificial Sequence: Synthetic iRNA agent targeting human EGLN1 oligonucleotide
uguauccuacuuucccaga

SEQ ID NO: 607 - RNA, 19 nt, Artificial Sequence
  Description of Artificial Sequence: Synthetic iRNA agent targeting human EGLN1 oligonucleotide
aaguaggauacacauaaga

SEQ ID NO: 608 - RNA, 19 nt, Artificial Sequence
  Description of Artificial Sequence: Synthetic iRNA agent targeting human EGLN1 oligonucleotide
ucuuauguguauccuacuu

SEQ ID NO: 609 - RNA, 19 nt, Artificial Sequence
  Description of Artificial Sequence: Synthetic iRNA agent targeting human EGLN1 oligonucleotide
ggauacacauaagacaggu

SEQ ID NO: 610 - RNA, 19 nt, Artificial Sequence
  Description of Artificial Sequence: Synthetic iRNA agent targeting human EGLN1 oligonucleotide
accugucuuauguguaucc

SEQ ID NO: 611 - RNA, 19 nt, Artificial Sequence
  Description of Artificial Sequence: Synthetic iRNA agent targeting human EGLN1 oligonucleotide
acauaagacaggucuaggu

SEQ ID NO: 612 - RNA, 19 nt, Artificial Sequence
  Description of Artificial Sequence: Synthetic iRNA agent targeting human EGLN1 oligonucleotide
accuagaccugucuuaugu

SEQ ID NO: 613 - RNA, 19 nt, Artificial Sequence
  Description of Artificial Sequence: Synthetic iRNA agent targeting human EGLN1 oligonucleotide
agacaggucuaggucuaaa

SEQ ID NO: 614 - RNA, 19 nt, Artificial Sequence
  Description of Artificial Sequence: Synthetic iRNA agent targeting human EGLN1 oligonucleotide
uuuagaccuagaccugucu

SEQ ID NO: 615 - RNA, 19 nt, Artificial Sequence
  Description of Artificial Sequence: Synthetic iRNA agent targeting human EGLN1 oligonucleotide
gacaggucuaggucuaaau

SEQ ID NO: 616 - RNA, 19 nt, Artificial Sequence
  Description of Artificial Sequence: Synthetic iRNA agent targeting human EGLN1 oligonucleotide
auuuagaccuagaccuguc

SEQ ID NO: 617 - RNA, 19 nt, Artificial Sequence
  Description of Artificial Sequence: Synthetic iRNA agent targeting human EGLN1 oligonucleotide
aggucuaggucuaaauucu

SEQ ID NO: 618 - RNA, 19 nt, Artificial Sequence
  Description of Artificial Sequence: Synthetic iRNA agent targeting human EGLN1 oligonucleotide
agaauuuagaccuagaccu

SEQ ID NO: 619 - RNA, 19 nt, Artificial Sequence
  Description of Artificial Sequence: Synthetic iRNA agent targeting human EGLN1 oligonucleotide
ggucuaggucuaaauucuu

SEQ ID NO: 620 - RNA, 19 nt, Artificial Sequence
  Description of Artificial Sequence: Synthetic iRNA agent targeting human EGLN1 oligonucleotide
aagaauuuagaccuagacc

SEQ ID NO: 621 - RNA, 19 nt, Artificial Sequence
  Description of Artificial Sequence: Synthetic iRNA agent targeting human EGLN1 oligonucleotide
uaggucuaaauucuuuaca

SEQ ID NO: 622 - RNA, 19 nt, Artificial Sequence
  Description of Artificial Sequence: Synthetic iRNA agent targeting human EGLN1 oligonucleotide
uguaaagaauuuagaccua

SEQ ID NO: 623 - RNA, 19 nt, Artificial Sequence
  Description of Artificial Sequence: Synthetic iRNA agent targeting human EGLN1 oligonucleotide
uucuuuacagaaacuugga

SEQ ID NO: 624 - RNA, 19 nt, Artificial Sequence
  Description of Artificial Sequence: Synthetic iRNA agent targeting human EGLN1 oligonucleotide
uccaaguuucuguaaagaa

SEQ ID NO: 625 - RNA, 19 nt, Artificial Sequence
  Description of Artificial Sequence: Synthetic iRNA agent targeting human EGLN1 oligonucleotide
guuucccaaaggacaagcu

SEQ ID NO: 626 - RNA, 19 nt, Artificial Sequence
  Description of Artificial Sequence: Synthetic iRNA agent targeting human EGLN1 oligonucleotide
agcuuguccuuugggaaac

SEQ ID NO: 627 - RNA, 19 nt, Artificial Sequence
  Description of Artificial Sequence: Synthetic iRNA agent targeting human EGLN1 oligonucleotide
cauccucuuucacuugauu

SEQ ID NO: 628 - RNA, 19 nt, Artificial Sequence
  Description of Artificial Sequence: Synthetic iRNA agent targeting human EGLN1 oligonucleotide
aaucaagugaaagaggaug

SEQ ID NO: 629 - RNA, 19 nt, Artificial Sequence
  Description of Artificial Sequence: Synthetic iRNA agent targeting human EGLN1 oligonucleotide
uuuacgcaugcagcaggau

SEQ ID NO: 630 - RNA, 19 nt, Artificial Sequence
  Description of Artificial Sequence: Synthetic iRNA agent targeting human EGLN1 oligonucleotide
auccugcugcaugcguaaa

SEQ ID NO: 631 - RNA, 19 nt, Artificial Sequence
  Description of Artificial Sequence: Synthetic iRNA agent targeting human EGLN1 oligonucleotide
uuacgcaugcagcaggauu

SEQ ID NO: 632 - RNA, 19 nt, Artificial Sequence
  Description of Artificial Sequence: Synthetic iRNA agent targeting human EGLN1 oligonucleotide
aauccugcugcaugcguaa

SEQ ID NO: 633 - RNA, 19 nt, Artificial Sequence
  Description of Artificial Sequence: Synthetic iRNA agent targeting human EGLN1 oligonucleotide
gcaggauuuuauaacaguu

SEQ ID NO: 634 - RNA, 19 nt, Artificial Sequence
  Description of Artificial Sequence: Synthetic iRNA agent targeting human EGLN1 oligonucleotide
aacuguuauaaaauccugc

SEQ ID NO: 635 - RNA, 19 nt, Artificial Sequence
  Description of Artificial Sequence: Synthetic iRNA agent targeting human EGLN1 oligonucleotide
ugguuuacaauaauuccuu

SEQ ID NO: 636 - RNA, 19 nt, Artificial Sequence
  Description of Artificial Sequence: Synthetic iRNA agent targeting human EGLN1 oligonucleotide
aaggaauuauuguaaacca

SEQ ID NO: 637 - RNA, 19 nt, Artificial Sequence
  Description of Artificial Sequence: Synthetic iRNA agent targeting human EGLN1 oligonucleotide
aauacauauuacaacuuuu

SEQ ID NO: 638 - RNA, 19 nt, Artificial Sequence
  Description of Artificial Sequence: Synthetic iRNA agent targeting human EGLN1 oligonucleotide
aaaaguuguaauauguauu

SEQ ID NO: 639 - RNA, 19 nt, Artificial Sequence
  Description of Artificial Sequence: Synthetic iRNA agent targeting human EGLN1 oligonucleotide
uaaguuuggaaggcuauau

SEQ ID NO: 640 - RNA, 19 nt, Artificial Sequence
  Description of Artificial Sequence: Synthetic iRNA agent targeting human EGLN1 oligonucleotide
auauagccuuccaaacuua

SEQ ID NO: 641 - RNA, 19 nt, Artificial Sequence
  Description of Artificial Sequence: Synthetic iRNA agent targeting human EGLN1 oligonucleotide
aaguuuggaaggcuauauu

SEQ ID NO: 642 - RNA, 19 nt, Artificial Sequence
  Description of Artificial Sequence: Synthetic iRNA agent targeting human EGLN1 oligonucleotide
aauauagccuuccaaacuu

SEQ ID NO: 643 - RNA, 19 nt, Artificial Sequence
  Description of Artificial Sequence: Synthetic iRNA agent targeting human EGLN1 oligonucleotide
uuuggaaggcuauauuuca

SEQ ID NO: 644 - RNA, 19 nt, Artificial Sequence
  Description of Artificial Sequence: Synthetic iRNA agent targeting human EGLN1 oligonucleotide
ugaaauauagccuuccaaa

SEQ ID NO: 645 - RNA, 19 nt, Artificial Sequence
  Description of Artificial Sequence: Synthetic iRNA agent targeting human EGLN1 oligonucleotide
acugaaguuacaguauacu

SEQ ID NO: 646 - RNA, 19 nt, Artificial Sequence
  Description of Artificial Sequence: Synthetic iRNA agent targeting human EGLN1 oligonucleotide
aguauacuguaacuucagu

SEQ ID NO: 647 - RNA, 19 nt, Artificial Sequence
  Description of Artificial Sequence: Synthetic iRNA agent targeting human EGLN1 oligonucleotide
ugaaguuacaguauacuca

SEQ ID NO: 648 - RNA, 19 nt, Artificial Sequence
  Description of Artificial Sequence: Synthetic iRNA agent targeting human EGLN1 oligonucleotide
ugaguauacuguaacuuca

SEQ ID NO: 649 - RNA, 19 nt, Artificial Sequence
  Description of Artificial Sequence: Synthetic iRNA agent targeting human EGLN1 oligonucleotide
gaaguuacaguauacucaa

SEQ ID NO: 650 - RNA, 19 nt, Artificial Sequence
  Description of Artificial Sequence: Synthetic iRNA agent targeting human EGLN1 oligonucleotide
uugaguauacuguaacuuc

SEQ ID NO: 651 - RNA, 19 nt, Artificial Sequence
  Description of Artificial Sequence: Synthetic iRNA agent targeting human EGLN1 oligonucleotide
auacucaagugauacacaa

SEQ ID NO: 652 - RNA, 19 nt, Artificial Sequence
  Description of Artificial Sequence: Synthetic iRNA agent targeting human EGLN1 oligonucleotide
uuguguaucacuugaguau

SEQ ID NO: 653 - RNA, 19 nt, Artificial Sequence
  Description of Artificial Sequence: Synthetic iRNA agent targeting human EGLN1 oligonucleotide
gugauacacaagccuagca

SEQ ID NO: 654 - RNA, 19 nt, Artificial Sequence
  Description of Artificial Sequence: Synthetic iRNA agent targeting human EGLN1 oligonucleotide
ugcuaggcuuguguaucac

SEQ ID NO: 655 - RNA, 19 nt, Artificial Sequence
  Description of Artificial Sequence: Synthetic iRNA agent targeting human EGLN1 oligonucleotide
acacaagccuagcacccca

SEQ ID NO: 656 - RNA, 19 nt, Artificial Sequence
  Description of Artificial Sequence: Synthetic iRNA agent targeting human EGLN1 oligonucleotide
uggggugcuaggcuugugu

SEQ ID NO: 657 - RNA, 19 nt, Artificial Sequence
  Description of Artificial Sequence: Synthetic iRNA agent targeting human EGLN1 oligonucleotide
cccacuuuccacauagugu

SEQ ID NO: 658 - RNA, 19 nt, Artificial Sequence
  Description of Artificial Sequence: Synthetic iRNA agent targeting human EGLN1 oligonucleotide
acacuauguggaaaguggg

SEQ ID NO: 659 - RNA, 19 nt, Artificial Sequence
  Description of Artificial Sequence: Synthetic iRNA agent targeting human EGLN1 oligonucleotide
cuuuccacauaguguucga

SEQ ID NO: 660 - RNA, 19 nt, Artificial Sequence
  Description of Artificial Sequence: Synthetic iRNA agent targeting human EGLN1 oligonucleotide
ucgaacacuauguggaaag

SEQ ID NO: 661 - RNA, 19 nt, Artificial Sequence
  Description of Artificial Sequence: Synthetic iRNA agent targeting human EGLN1 oligonucleotide
uuuccacauaguguucgau

SEQ ID NO: 662 - RNA, 19 nt, Artificial Sequence
  Description of Artificial Sequence: Synthetic iRNA agent targeting human EGLN1 oligonucleotide
aucgaacacuauguggaaa

SEQ ID NO: 663 - RNA, 19 nt, Artificial Sequence
  Description of Artificial Sequence: Synthetic iRNA agent targeting human EGLN1 oligonucleotide
uuccacauaguguucgaua

SEQ ID NO: 664 - RNA, 19 nt, Artificial Sequence
  Description of Artificial Sequence: Synthetic iRNA agent targeting human EGLN1 oligonucleotide
uaucgaacacuauguggaa

SEQ ID NO: 665 - RNA, 19 nt, Artificial Sequence
  Description of Artificial Sequence: Synthetic iRNA agent targeting human EGLN1 oligonucleotide
uccacauaguguucgauaa

SEQ ID NO: 666 - RNA, 19 nt, Artificial Sequence
  Description of Artificial Sequence: Synthetic iRNA agent targeting human EGLN1 oligonucleotide
uuaucgaacacuaugugga

SEQ ID NO: 667 - RNA, 19 nt, Artificial Sequence
  Description of Artificial Sequence: Synthetic iRNA agent targeting human EGLN1 oligonucleotide
ccacauaguguucgauaaa

SEQ ID NO: 668 - RNA, 19 nt, Artificial Sequence
  Description of Artificial Sequence: Synthetic iRNA agent targeting human EGLN1 oligonucleotide
uuuaucgaacacuaugugg

SEQ ID NO: 669 - RNA, 19 nt, Artificial Sequence
  Description of Artificial Sequence: Synthetic iRNA agent targeting human EGLN1 oligonucleotide
auaguguucgauaaagauu

SEQ ID NO: 670 - RNA, 19 nt, Artificial Sequence
  Description of Artificial Sequence: Synthetic iRNA agent targeting human EGLN1 oligonucleotide
aaucuuuaucgaacacuau

SEQ ID NO: 671 - RNA, 19 nt, Artificial Sequence
  Description of Artificial Sequence: Synthetic iRNA agent targeting human EGLN1 oligonucleotide
uguucgauaaagauugaua

SEQ ID NO: 672 - RNA, 19 nt, Artificial Sequence
  Description of Artificial Sequence: Synthetic iRNA agent targeting human EGLN1 oligonucleotide
uaucaaucuuuaucgaaca

SEQ ID NO: 673 - RNA, 19 nt, Artificial Sequence
  Description of Artificial Sequence: Synthetic iRNA agent targeting human EGLN1 oligonucleotide
uucgauaaagauugauaaa

SEQ ID NO: 674 - RNA, 19 nt, Artificial Sequence
  Description of Artificial Sequence: Synthetic iRNA agent targeting human EGLN1 oligonucleotide
uuuaucaaucuuuaucgaa

SEQ ID NO: 675 - RNA, 19 nt, Artificial Sequence
  Description of Artificial Sequence: Synthetic iRNA agent targeting human EGLN1 oligonucleotide
auugauaaacucgaaauca

SEQ ID NO: 676 - RNA, 19 nt, Artificial Sequence
  Description of Artificial Sequence: Synthetic iRNA agent targeting human EGLN1 oligonucleotide
ugauuucgaguuuaucaau

SEQ ID NO: 677 - RNA, 19 nt, Artificial Sequence
  Description of Artificial Sequence: Synthetic iRNA agent targeting human EGLN1 oligonucleotide
ugauaaacucgaaaucaca

SEQ ID NO: 678 - RNA, 19 nt, Artificial Sequence
  Description of Artificial Sequence: Synthetic iRNA agent targeting human EGLN1 oligonucleotide
ugugauuucgaguuuauca

SEQ ID NO: 679 - RNA, 19 nt, Artificial Sequence
  Description of Artificial Sequence: Synthetic iRNA agent targeting human EGLN1 oligonucleotide
auaaacucgaaaucacaga

SEQ ID NO: 680 - RNA, 19 nt, Artificial Sequence
  Description of Artificial Sequence: Synthetic iRNA agent targeting human EGLN1 oligonucleotide
ucugugauuucgaguuuau

SEQ ID NO: 681 - RNA, 19 nt, Artificial Sequence
  Description of Artificial Sequence: Synthetic iRNA agent targeting human EGLN1 oligonucleotide
acucgaaaucacagaccuu

SEQ ID NO: 682 - RNA, 19 nt, Artificial Sequence
  Description of Artificial Sequence: Synthetic iRNA agent targeting human EGLN1 oligonucleotide
aaggucugugauuucgagu

SEQ ID NO: 683 - RNA, 19 nt, Artificial Sequence
  Description of Artificial Sequence: Synthetic iRNA agent targeting human EGLN1 oligonucleotide
cagaccuuuuaauucuuaa

SEQ ID NO: 684 - RNA, 19 nt, Artificial Sequence
  Description of Artificial Sequence: Synthetic iRNA agent targeting human EGLN1 oligonucleotide
uuaagaauuaaaaggucug

SEQ ID NO: 685 - RNA, 19 nt, Artificial Sequence
  Description of Artificial Sequence: Synthetic iRNA agent targeting human EGLN1 oligonucleotide
ggcuuauuucugguaaggu

SEQ ID NO: 686 - RNA, 19 nt, Artificial Sequence
  Description of Artificial Sequence: Synthetic iRNA agent targeting human EGLN1 oligonucleotide
accuuaccagaaauaagcc

SEQ ID NO: 687 - RNA, 19 nt, Artificial Sequence
  Description of Artificial Sequence: Synthetic iRNA agent targeting human EGLN1 oligonucleotide
cuuauuucugguaagguuu

SEQ ID NO: 688 - RNA, 19 nt, Artificial Sequence
  Description of Artificial Sequence: Synthetic iRNA agent targeting human EGLN1 oligonucleotide
aaaccuuaccagaaauaag

SEQ ID NO: 689 - RNA, 19 nt, Artificial Sequence
  Description of Artificial Sequence: Synthetic iRNA agent targeting human EGLN1 oligonucleotide
aauuguauucauccgcgca

SEQ ID NO: 690 - RNA, 19 nt, Artificial Sequence
  Description of Artificial Sequence: Synthetic iRNA agent targeting human EGLN1 oligonucleotide
ugcgcggaugaauacaauu

SEQ ID NO: 691 - RNA, 19 nt, Artificial Sequence
  Description of Artificial Sequence: Synthetic iRNA agent targeting human EGLN1 oligonucleotide
uguauucauccgcgcagca

SEQ ID NO: 692 - RNA, 19 nt, Artificial Sequence
  Description of Artificial Sequence: Synthetic iRNA agent targeting human EGLN1 oligonucleotide
ugcugcgcggaugaauaca

SEQ ID NO: 693 - RNA, 19 nt, Artificial Sequence
  Description of Artificial Sequence: Synthetic iRNA agent targeting human EGLN1 oligonucleotide
uauucauccgcgcagcaca

SEQ ID NO: 694 - RNA, 19 nt, Artificial Sequence
  Description of Artificial Sequence: Synthetic iRNA agent targeting human EGLN1 oligonucleotide
ugugcugcgcggaugaaua

SEQ ID NO: 695 - RNA, 19 nt, Artificial Sequence
  Description of Artificial Sequence: Synthetic iRNA agent targeting human EGLN1 oligonucleotide
aaauaaaugugagagucgu

SEQ ID NO: 696 - RNA, 19 nt, Artificial Sequence
  Description of Artificial Sequence: Synthetic iRNA agent targeting human EGLN1 oligonucleotide
acgacucucacauuuauuu

SEQ ID NO: 697 - RNA, 19 nt, Artificial Sequence
  Description of Artificial Sequence: Synthetic iRNA agent targeting human EGLN1 oligonucleotide
auaaaugugagagucguua

SEQ ID NO: 698 - RNA, 19 nt, Artificial Sequence
  Description of Artificial Sequence: Synthetic iRNA agent targeting human EGLN1 oligonucleotide
uaacgacucucacauuuau

SEQ ID NO: 699 - RNA, 19 nt, Artificial Sequence
  Description of Artificial Sequence: Synthetic iRNA agent targeting human EGLN1 oligonucleotide
uaaaugugagagucguuaa

SEQ ID NO: 700 - RNA, 19 nt, Artificial Sequence
  Description of Artificial Sequence: Synthetic iRNA agent targeting human EGLN1 oligonucleotide
uuaacgacucucacauuua

SEQ ID NO: 701 - RNA, 19 nt, Artificial Sequence
  Description of Artificial Sequence: Synthetic iRNA agent targeting human EGLN1 oligonucleotide
augugagagucguuaaugu

SEQ ID NO: 702 - RNA, 19 nt, Artificial Sequence
  Description of Artificial Sequence: Synthetic iRNA agent targeting human EGLN1 oligonucleotide
acauuaacgacucucacau

SEQ ID NO: 703 - RNA, 19 nt, Artificial Sequence
  Description of Artificial Sequence: Synthetic iRNA agent targeting human EGLN1 oligonucleotide
ugagagucguuaauguagu

SEQ ID NO: 704 - RNA, 19 nt, Artificial Sequence
  Description of Artificial Sequence: Synthetic iRNA agent targeting human EGLN1 oligonucleotide
acuacauuaacgacucuca

SEQ ID NO: 705 - RNA, 19 nt, Artificial Sequence
  Description of Artificial Sequence: Synthetic iRNA agent targeting human EGLN1 oligonucleotide
gagagucguuaauguagua

SEQ ID NO: 706 - RNA, 19 nt, Artificial Sequence
  Description of Artificial Sequence: Synthetic iRNA agent targeting human EGLN1 oligonucleotide
uacuacauuaacgacucuc

SEQ ID NO: 707 - RNA, 19 nt, Artificial Sequence
  Description of Artificial Sequence: Synthetic iRNA agent targeting human EGLN1 oligonucleotide
gagucguuaauguaguacu

SEQ ID NO: 708 - RNA, 19 nt, Artificial Sequence
  Description of Artificial Sequence: Synthetic iRNA agent targeting human EGLN1 oligonucleotide
aguacuacauuaacgacuc

SEQ ID NO: 709 - RNA, 19 nt, Artificial Sequence
  Description of Artificial Sequence: Synthetic iRNA agent targeting human EGLN1 oligonucleotide
aauguaguacugcucauuu

SEQ ID NO: 710 - RNA, 19 nt, Artificial Sequence
  Description of Artificial Sequence: Synthetic iRNA agent targeting human EGLN1 oligonucleotide
aaaugagcaguacuacauu

SEQ ID NO: 711 - RNA, 19 nt, Artificial Sequence
  Description of Artificial Sequence: Synthetic iRNA agent targeting human EGLN1 oligonucleotide
cuuuucaggaauaauccca

SEQ ID NO: 712 - RNA, 19 nt, Artificial Sequence
  Description of Artificial Sequence: Synthetic iRNA agent targeting human EGLN1 oligonucleotide
ugggauuauuccugaaaag

SEQ ID NO: 713 - RNA, 19 nt, Artificial Sequence
  Description of Artificial Sequence: Synthetic iRNA agent targeting human EGLN1 oligonucleotide
cauugauuacauuuaacuu

SEQ ID NO: 714 - RNA, 19 nt, Artificial Sequence
  Description of Artificial Sequence: Synthetic iRNA agent targeting human EGLN1 oligonucleotide
aaguuaaauguaaucaaug

SEQ ID NO: 715 - RNA, 19 nt, Artificial Sequence
  Description of Artificial Sequence: Synthetic iRNA agent targeting human EGLN1 oligonucleotide
ugauuacauuuaacuuggu

SEQ ID NO: 716 - RNA, 19 nt, Artificial Sequence
  Description of Artificial Sequence: Synthetic iRNA agent targeting human EGLN1 oligonucleotide
accaaguuaaauguaauca

SEQ ID NO: 717 - RNA, 19 nt, Artificial Sequence
  Description of Artificial Sequence: Synthetic iRNA agent targeting human EGLN1 oligonucleotide
cauuuaacuugguagccca

SEQ ID NO: 718 - RNA, 19 nt, Artificial Sequence
  Description of Artificial Sequence: Synthetic iRNA agent targeting human EGLN1 oligonucleotide
ugggcuaccaaguuaaaug

SEQ ID NO: 719 - RNA, 19 nt, Artificial Sequence
  Description of Artificial Sequence: Synthetic iRNA agent targeting human EGLN1 oligonucleotide
uuuaacuugguagcccaaa

SEQ ID NO: 720 - RNA, 19 nt, Artificial Sequence
  Description of Artificial Sequence: Synthetic iRNA agent targeting human EGLN1 oligonucleotide
uuugggcuaccaaguuaaa

SEQ ID NO: 721 - RNA, 19 nt, Artificial Sequence
  Description of Artificial Sequence: Synthetic iRNA agent targeting human EGLN1 oligonucleotide
acuugguagcccaaaauuu

SEQ ID NO: 722 - RNA, 19 nt, Artificial Sequence
  Description of Artificial Sequence: Synthetic iRNA agent targeting human EGLN1 oligonucleotide
aaauuuugggcuaccaagu

SEQ ID NO: 723 - RNA, 19 nt, Artificial Sequence
  Description of Artificial Sequence: Synthetic iRNA agent targeting human EGLN1 oligonucleotide
ugguagcccaaaauuucuu

SEQ ID NO: 724 - RNA, 19 nt, Artificial Sequence
  Description of Artificial Sequence: Synthetic iRNA agent targeting human EGLN1 oligonucleotide
aagaaauuuugggcuacca

SEQ ID NO: 725 - RNA, 19 nt, Artificial Sequence
  Description of Artificial Sequence: Synthetic iRNA agent targeting human EGLN1 oligonucleotide
aaaauuucuucaugggguu

SEQ ID NO: 726 - RNA, 19 nt, Artificial Sequence
  Description of Artificial Sequence: Synthetic iRNA agent targeting human EGLN1 oligonucleotide
aaccccaugaagaaauuuu

SEQ ID NO: 727 - RNA, 19 nt, Artificial Sequence
  Description of Artificial Sequence: Synthetic iRNA agent targeting human EGLN1 oligonucleotide
gguuuugaacucggcggga

SEQ ID NO: 728 - RNA, 19 nt, Artificial Sequence
  Description of Artificial Sequence: Synthetic iRNA agent targeting human EGLN1 oligonucleotide
ucccgccgaguucaaaacc

SEQ ID NO: 729 - RNA, 19 nt, Artificial Sequence
  Description of Artificial Sequence: Synthetic iRNA agent targeting human EGLN1 oligonucleotide
guuuugaacucggcgggau

SEQ ID NO: 730 - RNA, 19 nt, Artificial Sequence
  Description of Artificial Sequence: Synthetic iRNA agent targeting human EGLN1 oligonucleotide
aucccgccgaguucaaaac

SEQ ID NO: 731 - RNA, 19 nt, Artificial Sequence
  Description of Artificial Sequence: Synthetic iRNA agent targeting human EGLN1 oligonucleotide
uuuugaacucggcgggauu

SEQ ID NO: 732 - RNA, 19 nt, Artificial Sequence
  Description of Artificial Sequence: Synthetic iRNA agent targeting human EGLN1 oligonucleotide
aaucccgccgaguucaaaa

SEQ ID NO: 733 - RNA, 19 nt, Artificial Sequence
  Description of Artificial Sequence: Synthetic iRNA agent targeting human EGLN1 oligonucleotide
uuugaacucggcgggauuu

SEQ ID NO: 734 - RNA, 19 nt, Artificial Sequence
  Description of Artificial Sequence: Synthetic iRNA agent targeting human EGLN1 oligonucleotide
aaaucccgccgaguucaaa

SEQ ID NO: 735 - RNA, 19 nt, Artificial Sequence
  Description of Artificial Sequence: Synthetic iRNA agent targeting human EGLN1 oligonucleotide
aacucggcgggauuucaaa

SEQ ID NO: 736 - RNA, 19 nt, Artificial Sequence
  Description of Artificial Sequence: Synthetic iRNA agent targeting human EGLN1 oligonucleotide
uuugaaaucccgccgaguu

SEQ ID NO: 737 - RNA, 19 nt, Artificial Sequence
  Description of Artificial Sequence: Synthetic iRNA agent targeting human EGLN1 oligonucleotide
uaccuuuaaacuaggucga

SEQ ID NO: 738 - RNA, 19 nt, Artificial Sequence
  Description of Artificial Sequence: Synthetic iRNA agent targeting human EGLN1 oligonucleotide
ucgaccuaguuuaaaggua

SEQ ID NO: 739 - RNA, 19 nt, Artificial Sequence
  Description of Artificial Sequence: Synthetic iRNA agent targeting human EGLN1 oligonucleotide
ccuuuaaacuaggucgaaa

SEQ ID NO: 740 - RNA, 19 nt, Artificial Sequence
  Description of Artificial Sequence: Synthetic iRNA agent targeting human EGLN1 oligonucleotide
uuucgaccuaguuuaaagg

SEQ ID NO: 741 - RNA, 19 nt, Artificial Sequence
  Description of Artificial Sequence: Synthetic iRNA agent targeting human EGLN1 oligonucleotide
uaggucgaaacggggcgca

SEQ ID NO: 742 - RNA, 19 nt, Artificial Sequence
  Description of Artificial Sequence: Synthetic iRNA agent targeting human EGLN1 oligonucleotide
ugcgccccguuucgaccua

SEQ ID NO: 743 - RNA, 19 nt, Artificial Sequence
  Description of Artificial Sequence: Synthetic iRNA agent targeting human EGLN1 oligonucleotide
aggucgaaacggggcgcaa

SEQ ID NO: 744 - RNA, 19 nt, Artificial Sequence
  Description of Artificial Sequence: Synthetic iRNA agent targeting human EGLN1 oligonucleotide
uugcgccccguuucgaccu

SEQ ID NO: 745 - RNA, 19 nt, Artificial Sequence
  Description of Artificial Sequence: Synthetic iRNA agent targeting human EGLN1 oligonucleotide
gucgaaacggggcgcaaga

SEQ ID NO: 746 - RNA, 19 nt, Artificial Sequence
  Description of Artificial Sequence: Synthetic iRNA agent targeting human EGLN1 oligonucleotide
ucuugcgccccguuucgac

SEQ ID NO: 747 - RNA, 19 nt, Artificial Sequence
  Description of Artificial Sequence: Synthetic iRNA agent targeting human EGLN1 oligonucleotide
aaacggggcgcaagagauu

SEQ ID NO: 748 - RNA, 19 nt, Artificial Sequence
  Description of Artificial Sequence: Synthetic iRNA agent targeting human EGLN1 oligonucleotide
aaucucuugcgccccguuu

SEQ ID NO: 749 - RNA, 19 nt, Artificial Sequence
  Description of Artificial Sequence: Synthetic iRNA agent targeting human EGLN1 oligonucleotide
gggcgcaagagauuggauu

SEQ ID NO: 750 - RNA, 19 nt, Artificial Sequence
  Description of Artificial Sequence: Synthetic iRNA agent targeting human EGLN1 oligonucleotide
aauccaaucucuugcgccc

SEQ ID NO: 751 - RNA, 19 nt, Artificial Sequence
  Description of Artificial Sequence: Synthetic iRNA agent targeting human EGLN1 oligonucleotide
ggcgcaagagauuggauua

SEQ ID NO: 752 - RNA, 19 nt, Artificial Sequence
  Description of Artificial Sequence: Synthetic iRNA agent targeting human EGLN1 oligonucleotide
uaauccaaucucuugcgcc

SEQ ID NO: 753 - RNA, 19 nt, Artificial Sequence
  Description of Artificial Sequence: Synthetic iRNA agent targeting human EGLN1 oligonucleotide
gcgcaagagauuggauuaa

SEQ ID NO: 754 - RNA, 19 nt, Artificial Sequence
  Description of Artificial Sequence: Synthetic iRNA agent targeting human EGLN1 oligonucleotide
uuaauccaaucucuugcgc

SEQ ID NO: 755 - RNA, 19 nt, Artificial Sequence
  Description of Artificial Sequence: Synthetic iRNA agent targeting human EGLN1 oligonucleotide
gcaagagauuggauuaaca

SEQ ID NO: 756 - RNA, 19 nt, Artificial Sequence
  Description of Artificial Sequence: Synthetic iRNA agent targeting human EGLN1 oligonucleotide
uguuaauccaaucucuugc

SEQ ID NO: 757 - RNA, 19 nt, Artificial Sequence
  Description of Artificial Sequence: Synthetic iRNA agent targeting human EGLN1 oligonucleotide
agagauuggauuaacacca

SEQ ID NO: 758 - RNA, 19 nt, Artificial Sequence
  Description of Artificial Sequence: Synthetic iRNA agent targeting human EGLN1 oligonucleotide
ugguguuaauccaaucucu

SEQ ID NO: 759 - RNA, 19 nt, Artificial Sequence
  Description of Artificial Sequence: Synthetic iRNA agent targeting human EGLN1 oligonucleotide
auuggauuaacaccauagu

SEQ ID NO: 760 - RNA, 19 nt, Artificial Sequence
  Description of Artificial Sequence: Synthetic iRNA agent targeting human EGLN1 oligonucleotide
acuaugguguuaauccaau

SEQ ID NO: 761 - RNA, 19 nt, Artificial Sequence
  Description of Artificial Sequence: Synthetic iRNA agent targeting human EGLN1 oligonucleotide
acaccauaguaauacuuau

SEQ ID NO: 762 - RNA, 19 nt, Artificial Sequence
  Description of Artificial Sequence: Synthetic iRNA agent targeting human EGLN1 oligonucleotide
auaaguauuacuauggugu

SEQ ID NO: 763 - RNA, 19 nt, Artificial Sequence
  Description of Artificial Sequence: Synthetic iRNA agent targeting human EGLN1 oligonucleotide
caccauaguaauacuuauu

SEQ ID NO: 764 - RNA, 19 nt, Artificial Sequence
  Description of Artificial Sequence: Synthetic iRNA agent targeting human EGLN1 oligonucleotide
aauaaguauuacuauggug

SEQ ID NO: 765 - RNA, 19 nt, Artificial Sequence
  Description of Artificial Sequence: Synthetic iRNA agent targeting human EGLN1 oligonucleotide
guaauacuuauuuuguucu

SEQ ID NO: 766 - RNA, 19 nt, Artificial Sequence
  Description of Artificial Sequence: Synthetic iRNA agent targeting human EGLN1 oligonucleotide
agaacaaaauaaguauuac

SEQ ID NO: 767 - RNA, 19 nt, Artificial Sequence
  Description of Artificial Sequence: Synthetic iRNA agent targeting human EGLN1 oligonucleotide
cagggcuucuugaaauaga

SEQ ID NO: 768 - RNA, 19 nt, Artificial Sequence
  Description of Artificial Sequence: Synthetic iRNA agent targeting human EGLN1 oligonucleotide
ucuauuucaagaagcccug

SEQ ID NO: 769 - RNA, 19 nt, Artificial Sequence
  Description of Artificial Sequence: Synthetic iRNA agent targeting human EGLN1 oligonucleotide
aauagaggcuguauggugu

SEQ ID NO: 770 - RNA, 19 nt, Artificial Sequence
  Description of Artificial Sequence: Synthetic iRNA agent targeting human EGLN1 oligonucleotide
acaccauacagccucuauu

SEQ ID NO: 771 - RNA, 19 nt, Artificial Sequence
  Description of Artificial Sequence: Synthetic iRNA agent targeting human EGLN1 oligonucleotide
auagaggcuguauggugua

SEQ ID NO: 772 - RNA, 19 nt, Artificial Sequence
  Description of Artificial Sequence: Synthetic iRNA agent targeting human EGLN1 oligonucleotide
uacaccauacagccucuau

SEQ ID NO: 773 - RNA, 19 nt, Artificial Sequence
  Description of Artificial Sequence: Synthetic iRNA agent targeting human EGLN1 oligonucleotide
cuguaugguguaauggaaa

SEQ ID NO: 774 - RNA, 19 nt, Artificial Sequence
  Description of Artificial Sequence: Synthetic iRNA agent targeting human EGLN1 oligonucleotide
uuuccauuacaccauacag

SEQ ID NO: 775 - RNA, 19 nt, Artificial Sequence
  Description of Artificial Sequence: Synthetic iRNA agent targeting human EGLN1 oligonucleotide
uucagucccaguuuugcgu

SEQ ID NO: 776 - RNA, 19 nt, Artificial Sequence
  Description of Artificial Sequence: Synthetic iRNA agent targeting human EGLN1 oligonucleotide
acgcaaaacugggacugaa

SEQ ID NO: 777 - RNA, 19 nt, Artificial Sequence
  Description of Artificial Sequence: Synthetic iRNA agent targeting human EGLN1 oligonucleotide
cagucccaguuuugcguga

SEQ ID NO: 778 - RNA, 19 nt, Artificial Sequence
  Description of Artificial Sequence: Synthetic iRNA agent targeting human EGLN1 oligonucleotide
ucacgcaaaacugggacug

SEQ ID NO: 779 - RNA, 19 nt, Artificial Sequence
  Description of Artificial Sequence: Synthetic iRNA agent targeting human EGLN1 oligonucleotide
cccaguuuugcgugaccuu

SEQ ID NO: 780 - RNA, 19 nt, Artificial Sequence
  Description of Artificial Sequence: Synthetic iRNA agent targeting human EGLN1 oligonucleotide
aaggucacgcaaaacuggg

SEQ ID NO: 781 - RNA, 19 nt, Artificial Sequence
  Description of Artificial Sequence: Synthetic iRNA agent targeting human EGLN1 oligonucleotide
cugcaaaaugaggaucgca

SEQ ID NO: 782 - RNA, 19 nt, Artificial Sequence
  Description of Artificial Sequence: Synthetic iRNA agent targeting human EGLN1 oligonucleotide
ugcgauccucauuuugcag

SEQ ID NO: 783 - RNA, 19 nt, Artificial Sequence
  Description of Artificial Sequence: Synthetic iRNA agent targeting human EGLN1 oligonucleotide
augaggaucgcaauagcca

SEQ ID NO: 784 - RNA, 19 nt, Artificial Sequence
  Description of Artificial Sequence: Synthetic iRNA agent targeting human EGLN1 oligonucleotide
uggcuauugcgauccucau

SEQ ID NO: 785 - RNA, 19 nt, Artificial Sequence
  Description of Artificial Sequence: Synthetic iRNA agent targeting human EGLN1 oligonucleotide
aggaucgcaauagccaccu

SEQ ID NO: 786 - RNA, 19 nt, Artificial Sequence
  Description of Artificial Sequence: Synthetic iRNA agent targeting human EGLN1 oligonucleotide
agguggcuauugcgauccu

SEQ ID NO: 787 - RNA, 19 nt, Artificial Sequence
  Description of Artificial Sequence: Synthetic iRNA agent targeting human EGLN1 oligonucleotide
ggaucgcaauagccaccuu

SEQ ID NO: 788 - RNA, 19 nt, Artificial Sequence
  Description of Artificial Sequence: Synthetic iRNA agent targeting human EGLN1 oligonucleotide
aagguggcuauugcgaucc

SEQ ID NO: 789 - RNA, 19 nt, Artificial Sequence
  Description of Artificial Sequence: Synthetic iRNA agent targeting human EGLN1 oligonucleotide
aauagccaccuugcaaccu

SEQ ID NO: 790 - RNA, 19 nt, Artificial Sequence
  Description of Artificial Sequence: Synthetic iRNA agent targeting human EGLN1 oligonucleotide
agguugcaagguggcuauu

SEQ ID NO: 791 - RNA, 19 nt, Artificial Sequence
  Description of Artificial Sequence: Synthetic iRNA agent targeting human EGLN1 oligonucleotide
ccaccuugcaaccuugacu

SEQ ID NO: 792 - RNA, 19 nt, Artificial Sequence
  Description of Artificial Sequence: Synthetic iRNA agent targeting human EGLN1 oligonucleotide
agucaagguugcaaggugg

SEQ ID NO: 793 - RNA, 19 nt, Artificial Sequence
  Description of Artificial Sequence: Synthetic iRNA agent targeting human EGLN1 oligonucleotide
gcaaccuugacuggagcga

SEQ ID NO: 794 - RNA, 19 nt, Artificial Sequence
  Description of Artificial Sequence: Synthetic iRNA agent targeting human EGLN1 oligonucleotide
ucgcuccagucaagguugc

SEQ ID NO: 795 - RNA, 19 nt, Artificial Sequence
  Description of Artificial Sequence: Synthetic iRNA agent targeting human EGLN1 oligonucleotide
cuggagcgagccucgcaca

SEQ ID NO: 796 - RNA, 19 nt, Artificial Sequence
  Description of Artificial Sequence: Synthetic iRNA agent targeting human EGLN1 oligonucleotide
ugugcgaggcucgcuccag

SEQ ID NO: 797 - RNA, 19 nt, Artificial Sequence
  Description of Artificial Sequence: Synthetic iRNA agent targeting human EGLN1 oligonucleotide
agccaugauuacgccgccu

SEQ ID NO: 798 - RNA, 19 nt, Artificial Sequence
  Description of Artificial Sequence: Synthetic iRNA agent targeting human EGLN1 oligonucleotide
aggcggcguaaucauggcu

SEQ ID NO: 799 - RNA, 19 nt, Artificial Sequence
  Description of Artificial Sequence: Synthetic iRNA agent targeting human EGLN1 oligonucleotide
gccaugauuacgccgccuu

SEQ ID NO: 800 - RNA, 19 nt, Artificial Sequence
  Description of Artificial Sequence: Synthetic iRNA agent targeting human EGLN1 oligonucleotide
aaggcggcguaaucauggc

SEQ ID NO: 801 - RNA, 19 nt, Artificial Sequence
  Description of Artificial Sequence: Synthetic iRNA agent targeting human EGLN1 oligonucleotide
uccagcagguguaggcgcu

SEQ ID NO: 802 - RNA, 19 nt, Artificial Sequence
  Description of Artificial Sequence: Synthetic iRNA agent targeting human EGLN1 oligonucleotide
agcgccuacaccugcugga

SEQ ID NO: 803 - RNA, 19 nt, Artificial Sequence
  Description of Artificial Sequence: Synthetic iRNA agent targeting human EGLN1 oligonucleotide
agggaaagcgggcgaccca

SEQ ID NO: 804 - RNA, 19 nt, Artificial Sequence
  Description of Artificial Sequence: Synthetic iRNA agent targeting human EGLN1 oligonucleotide
ugggucgcccgcuuucccu

SEQ ID NO: 805 - RNA, 19 nt, Artificial Sequence
  Description of Artificial Sequence: Synthetic iRNA agent targeting human EGLN1 oligonucleotide
gaaagcgggcgacccaccu

SEQ ID NO: 806 - RNA, 19 nt, Artificial Sequence
  Description of Artificial Sequence: Synthetic iRNA agent targeting human EGLN1 oligonucleotide
aggugggucgcccgcuuuc

SEQ ID NO: 807 - RNA, 19 nt, Artificial Sequence
  Description of Artificial Sequence: Synthetic iRNA agent targeting human EGLN1 oligonucleotide
gagcgaguggcgcccguau

SEQ ID NO: 808 - RNA, 19 nt, Artificial Sequence
  Description of Artificial Sequence: Synthetic iRNA agent targeting human EGLN1 oligonucleotide
auacgggcgccacucgcuc

SEQ ID NO: 809 - RNA, 19 nt, Artificial Sequence
  Description of Artificial Sequence: Synthetic iRNA agent targeting human EGLN1 oligonucleotide
aguggcgcccguaugcccu

SEQ ID NO: 810 - RNA, 19 nt, Artificial Sequence
  Description of Artificial Sequence: Synthetic iRNA agent targeting human EGLN1 oligonucleotide
agggcauacgggcgccacu

SEQ ID NO: 811 - RNA, 19 nt, Artificial Sequence
  Description of Artificial Sequence: Synthetic iRNA agent targeting human EGLN1 oligonucleotide
cagguugccauucgccgca

SEQ ID NO: 812 - RNA, 19 nt, Artificial Sequence
  Description of Artificial Sequence: Synthetic iRNA agent targeting human EGLN1 oligonucleotide
ugcggcgaauggcaaccug

SEQ ID NO: 813 - RNA, 19 nt, Artificial Sequence
  Description of Artificial Sequence: Synthetic iRNA agent targeting human EGLN1 oligonucleotide
gguugccauucgccgcaca

SEQ ID NO: 814 - RNA, 19 nt, Artificial Sequence
  Description of Artificial Sequence: Synthetic iRNA agent targeting human EGLN1 oligonucleotide
ugugcggcgaauggcaacc

SEQ ID NO: 815 - RNA, 19 nt, Artificial Sequence
  Description of Artificial Sequence: Synthetic iRNA agent targeting human EGLN1 oligonucleotide
uucgccgcacaggcccuau

SEQ ID NO: 816 - RNA, 19 nt, Artificial Sequence
  Description of Artificial Sequence: Synthetic iRNA agent targeting human EGLN1 oligonucleotide
auagggccugugcggcgaa

SEQ ID NO: 817 - RNA, 19 nt, Artificial Sequence
  Description of Artificial Sequence: Synthetic iRNA agent targeting human EGLN1 oligonucleotide
ucgccgcacaggcccuauu

SEQ ID NO: 818 - RNA, 19 nt, Artificial Sequence
  Description of Artificial Sequence: Synthetic iRNA agent targeting human EGLN1 oligonucleotide
aauagggccugugcggcga

SEQ ID NO: 819 - RNA, 19 nt, Artificial Sequence
  Description of Artificial Sequence: Synthetic iRNA agent targeting human EGLN1 oligonucleotide
gcgggugcauggcgcagua

SEQ ID NO: 820 - RNA, 19 nt, Artificial Sequence
  Description of Artificial Sequence: Synthetic iRNA agent targeting human EGLN1 oligonucleotide
uacugcgccaugcacccgc

SEQ ID NO: 821 - RNA, 19 nt, Artificial Sequence
  Description of Artificial Sequence: Synthetic iRNA agent targeting human EGLN1 oligonucleotide
cgggugcauggcgcaguaa

SEQ ID NO: 822 - RNA, 19 nt, Artificial Sequence
  Description of Artificial Sequence: Synthetic iRNA agent targeting human EGLN1 oligonucleotide
uuacugcgccaugcacccg

SEQ ID NO: 823 - RNA, 19 nt, Artificial Sequence
  Description of Artificial Sequence: Synthetic iRNA agent targeting human EGLN1 oligonucleotide
uggcgcaguaacggccccu

SEQ ID NO: 824 - RNA, 19 nt, Artificial Sequence
  Description of Artificial Sequence: Synthetic iRNA agent targeting human EGLN1 oligonucleotide
aggggccguuacugcgcca

SEQ ID NO: 825 - RNA, 19 nt, Artificial Sequence
  Description of Artificial Sequence: Synthetic iRNA agent targeting human EGLN1 oligonucleotide
ggcgcaguaacggccccua

SEQ ID NO: 826 - RNA, 19 nt, Artificial Sequence
  Description of Artificial Sequence: Synthetic iRNA agent targeting human EGLN1 oligonucleotide
uaggggccguuacugcgcc

SEQ ID NO: 827 - RNA, 19 nt, Artificial Sequence
  Description of Artificial Sequence: Synthetic iRNA agent targeting human EGLN1 oligonucleotide
acgcggccaagggaaaagu

SEQ ID NO: 828 - RNA, 19 nt, Artificial Sequence
  Description of Artificial Sequence: Synthetic iRNA agent targeting human EGLN1 oligonucleotide
acuuuucccuuggccgcgu

SEQ ID NO: 829 - RNA, 19 nt, Artificial Sequence
  Description of Artificial Sequence: Synthetic iRNA agent targeting human EGLN1 oligonucleotide
cccgcucaucgcuguucca

SEQ ID NO: 830 - RNA, 19 nt, Artificial Sequence
  Description of Artificial Sequence: Synthetic iRNA agent targeting human EGLN1 oligonucleotide
uggaacagcgaugagcggg

SEQ ID NO: 831 - RNA, 19 nt, Artificial Sequence
  Description of Artificial Sequence: Synthetic iRNA agent targeting human EGLN1 oligonucleotide
aggagaaggcgaaccugua

SEQ ID NO: 832 - RNA, 19 nt, Artificial Sequence
  Description of Artificial Sequence: Synthetic iRNA agent targeting human EGLN1 oligonucleotide
uacagguucgccuucuccu

SEQ ID NO: 833 - RNA, 19 nt, Artificial Sequence
  Description of Artificial Sequence: Synthetic iRNA agent targeting human EGLN1 oligonucleotide
caagcaacacgcccgggga

SEQ ID NO: 834 - RNA, 19 nt, Artificial Sequence
  Description of Artificial Sequence: Synthetic iRNA agent targeting human EGLN1 oligonucleotide
uccccgggcguguugcuug

SEQ ID NO: 835 - RNA, 19 nt, Artificial Sequence
  Description of Artificial Sequence: Synthetic iRNA agent targeting human EGLN1 oligonucleotide
ggcccaacgggcagacgaa

SEQ ID NO: 836 - RNA, 19 nt, Artificial Sequence
  Description of Artificial Sequence: Synthetic iRNA agent targeting human EGLN1 oligonucleotide
uucgucugcccguugggcc

SEQ ID NO: 837 - RNA, 19 nt, Artificial Sequence
  Description of Artificial Sequence: Synthetic iRNA agent targeting human EGLN1 oligonucleotide
agcuggcgcucgaguacau

SEQ ID NO: 838 - RNA, 19 nt, Artificial Sequence
  Description of Artificial Sequence: Synthetic iRNA agent targeting human EGLN1 oligonucleotide
auguacucgagcgccagcu

SEQ ID NO: 839 - RNA, 19 nt, Artificial Sequence
  Description of Artificial Sequence: Synthetic iRNA agent targeting human EGLN1 oligonucleotide
uggcgcucgaguacaucgu

SEQ ID NO: 840 - RNA, 19 nt, Artificial Sequence
  Description of Artificial Sequence: Synthetic iRNA agent targeting human EGLN1 oligonucleotide
acgauguacucgagcgcca

SEQ ID NO: 841 - RNA, 19 nt, Artificial Sequence
  Description of Artificial Sequence: Synthetic iRNA agent targeting human EGLN1 oligonucleotide
cucgaguacaucgugccgu

SEQ ID NO: 842 - RNA, 19 nt, Artificial Sequence
  Description of Artificial Sequence: Synthetic iRNA agent targeting human EGLN1 oligonucleotide
acggcacgauguacucgag

SEQ ID NO: 843 - RNA, 19 nt, Artificial Sequence
  Description of Artificial Sequence: Synthetic iRNA agent targeting human EGLN1 oligonucleotide
uacaucgugccgugcauga

SEQ ID NO: 844 - RNA, 19 nt, Artificial Sequence
  Description of Artificial Sequence: Synthetic iRNA agent targeting human EGLN1 oligonucleotide
ucaugcacggcacgaugua

SEQ ID NO: 845 - RNA, 19 nt, Artificial Sequence
  Description of Artificial Sequence: Synthetic iRNA agent targeting human EGLN1 oligonucleotide
aucgugccgugcaugaaca

SEQ ID NO: 846 - RNA, 19 nt, Artificial Sequence
  Description of Artificial Sequence: Synthetic iRNA agent targeting human EGLN1 oligonucleotide
uguucaugcacggcacgau

SEQ ID NO: 847 - RNA, 19 nt, Artificial Sequence
  Description of Artificial Sequence: Synthetic iRNA agent targeting human EGLN1 oligonucleotide
ugccgugcaugaacaagca

SEQ ID NO: 848 - RNA, 19 nt, Artificial Sequence
  Description of Artificial Sequence: Synthetic iRNA agent targeting human EGLN1 oligonucleotide
ugcuuguucaugcacggca

SEQ ID NO: 849 - RNA, 19 nt, Artificial Sequence
  Description of Artificial Sequence: Synthetic iRNA agent targeting human EGLN1 oligonucleotide
gaacaagcacggcaucugu

SEQ ID NO: 850 - RNA, 19 nt, Artificial Sequence
  Description of Artificial Sequence: Synthetic iRNA agent targeting human EGLN1 oligonucleotide
acagaugccgugcuuguuc

SEQ ID NO: 851 - RNA, 19 nt, Artificial Sequence
  Description of Artificial Sequence: Synthetic iRNA agent targeting human EGLN1 oligonucleotide
ucggcaaggagaccggaca

SEQ ID NO: 852 - RNA, 19 nt, Artificial Sequence
  Description of Artificial Sequence: Synthetic iRNA agent targeting human EGLN1 oligonucleotide
uguccggucuccuugccga

SEQ ID NO: 853 - RNA, 19 nt, Artificial Sequence
  Description of Artificial Sequence: Synthetic iRNA agent targeting human EGLN1 oligonucleotide
ccggacagcagaucggcga

SEQ ID NO: 854 - RNA, 19 nt, Artificial Sequence
  Description of Artificial Sequence: Synthetic iRNA agent targeting human EGLN1 oligonucleotide
ucgccgaucugcuguccgg

SEQ ID NO: 855 - RNA, 19 nt, Artificial Sequence
  Description of Artificial Sequence: Synthetic iRNA agent targeting human EGLN1 oligonucleotide
ugcacgacaccgggaaguu

SEQ ID NO: 856 - RNA, 19 nt, Artificial Sequence
  Description of Artificial Sequence: Synthetic iRNA agent targeting human EGLN1 oligonucleotide
aacuucccggugucgugca

SEQ ID NO: 857 - RNA, 19 nt, Artificial Sequence
  Description of Artificial Sequence: Synthetic iRNA agent targeting human EGLN1 oligonucleotide
ggaaguucacggacgggca

SEQ ID NO: 858 - RNA, 19 nt, Artificial Sequence
  Description of Artificial Sequence: Synthetic iRNA agent targeting human EGLN1 oligonucleotide
ugcccguccgugaacuucc

SEQ ID NO: 859 - RNA, 19 nt, Artificial Sequence
  Description of Artificial Sequence: Synthetic iRNA agent targeting human EGLN1 oligonucleotide
aaggacauccgaggcgaua

SEQ ID NO: 860 - RNA, 19 nt, Artificial Sequence
  Description of Artificial Sequence: Synthetic iRNA agent targeting human EGLN1 oligonucleotide
uaucgccucggauguccuu

SEQ ID NO: 861 - RNA, 19 nt, Artificial Sequence
  Description of Artificial Sequence: Synthetic iRNA agent targeting human EGLN1 oligonucleotide
aggacauccgaggcgauaa

SEQ ID NO: 862 - RNA, 19 nt, Artificial Sequence
  Description of Artificial Sequence: Synthetic iRNA agent targeting human EGLN1 oligonucleotide
uuaucgccucggauguccu

SEQ ID NO: 863 - RNA, 19 nt, Artificial Sequence
  Description of Artificial Sequence: Synthetic iRNA agent targeting human EGLN1 oligonucleotide
gacauccgaggcgauaaga

SEQ ID NO: 864 - RNA, 19 nt, Artificial Sequence
  Description of Artificial Sequence: Synthetic iRNA agent targeting human EGLN1 oligonucleotide
ucuuaucgccucggauguc

SEQ ID NO: 865 - RNA, 19 nt, Artificial Sequence
  Description of Artificial Sequence: Synthetic iRNA agent targeting human EGLN1 oligonucleotide
acauccgaggcgauaagau

SEQ ID NO: 866 - RNA, 19 nt, Artificial Sequence
  Description of Artificial Sequence: Synthetic iRNA agent targeting human EGLN1 oligonucleotide
aucuuaucgccucggaugu

SEQ ID NO: 867 - RNA, 19 nt, Artificial Sequence
  Description of Artificial Sequence: Synthetic iRNA agent targeting human EGLN1 oligonucleotide
auccgaggcgauaagauca

SEQ ID NO: 868 - RNA, 19 nt, Artificial Sequence
  Description of Artificial Sequence: Synthetic iRNA agent targeting human EGLN1 oligonucleotide
ugaucuuaucgccucggau

SEQ ID NO: 869 - RNA, 19 nt, Artificial Sequence
  Description of Artificial Sequence: Synthetic iRNA agent targeting human EGLN1 oligonucleotide
ggcgauaagaucaccugga

SEQ ID NO: 870 - RNA, 19 nt, Artificial Sequence
  Description of Artificial Sequence: Synthetic iRNA agent targeting human EGLN1 oligonucleotide
uccaggugaucuuaucgcc

SEQ ID NO: 871 - RNA, 19 nt, Artificial Sequence
  Description of Artificial Sequence: Synthetic iRNA agent targeting human EGLN1 oligonucleotide
auaagaucaccuggaucga

SEQ ID NO: 872 - RNA, 19 nt, Artificial Sequence
  Description of Artificial Sequence: Synthetic iRNA agent targeting human EGLN1 oligonucleotide
ucgauccaggugaucuuau

SEQ ID NO: 873 - RNA, 19 nt, Artificial Sequence
  Description of Artificial Sequence: Synthetic iRNA agent targeting human EGLN1 oligonucleotide
aucaccuggaucgagggca

SEQ ID NO: 874 - RNA, 19 nt, Artificial Sequence
  Description of Artificial Sequence: Synthetic iRNA agent targeting human EGLN1 oligonucleotide
ugcccucgauccaggugau

SEQ ID NO: 875 - RNA, 19 nt, Artificial Sequence
  Description of Artificial Sequence: Synthetic iRNA agent targeting human EGLN1 oligonucleotide
caaggagcccggcugcgaa

SEQ ID NO: 876 - RNA, 19 nt, Artificial Sequence
  Description of Artificial Sequence: Synthetic iRNA agent targeting human EGLN1 oligonucleotide
uucgcagccgggcuccuug

SEQ ID NO: 877 - RNA, 19 nt, Artificial Sequence
  Description of Artificial Sequence: Synthetic iRNA agent targeting human EGLN1 oligonucleotide
gagcccggcugcgaaacca

SEQ ID NO: 878 - RNA, 19 nt, Artificial Sequence
  Description of Artificial Sequence: Synthetic iRNA agent targeting human EGLN1 oligonucleotide
ugguuucgcagccgggcuc

SEQ ID NO: 879 - RNA, 19 nt, Artificial Sequence
  Description of Artificial Sequence: Synthetic iRNA agent targeting human EGLN1 oligonucleotide
agcccggcugcgaaaccau

SEQ ID NO: 880 - RNA, 19 nt, Artificial Sequence
  Description of Artificial Sequence: Synthetic iRNA agent targeting human EGLN1 oligonucleotide
augguuucgcagccgggcu

SEQ ID NO: 881 - RNA, 19 nt, Artificial Sequence
  Description of Artificial Sequence: Synthetic iRNA agent targeting human EGLN1 oligonucleotide
gcugcgaaaccauugggcu

SEQ ID NO: 882 - RNA, 19 nt, Artificial Sequence
  Description of Artificial Sequence: Synthetic iRNA agent targeting human EGLN1 oligonucleotide
agcccaaugguuucgcagc

SEQ ID NO: 883 - RNA, 19 nt, Artificial Sequence
  Description of Artificial Sequence: Synthetic iRNA agent targeting human EGLN1 oligonucleotide
gcgaaaccauugggcugcu

SEQ ID NO: 884 - RNA, 19 nt, Artificial Sequence
  Description of Artificial Sequence: Synthetic iRNA agent targeting human EGLN1 oligonucleotide
agcagcccaaugguuucgc

SEQ ID NO: 885 - RNA, 19 nt, Artificial Sequence
  Description of Artificial Sequence: Synthetic iRNA agent targeting human EGLN1 oligonucleotide
cagcauggacgaccugaua

SEQ ID NO: 886 - RNA, 19 nt, Artificial Sequence
  Description of Artificial Sequence: Synthetic iRNA agent targeting human EGLN1 oligonucleotide
uaucaggucguccaugcug

SEQ ID NO: 887 - RNA, 19 nt, Artificial Sequence
  Description of Artificial Sequence: Synthetic iRNA agent targeting human EGLN1 oligonucleotide
uggacgaccugauacgcca

SEQ ID NO: 888 - RNA, 19 nt, Artificial Sequence
  Description of Artificial Sequence: Synthetic iRNA agent targeting human EGLN1 oligonucleotide
uggcguaucaggucgucca

SEQ ID NO: 889 - RNA, 19 nt, Artificial Sequence
  Description of Artificial Sequence: Synthetic iRNA agent targeting human EGLN1 oligonucleotide
cgaccugauacgccacugu

SEQ ID NO: 890 - RNA, 19 nt, Artificial Sequence
  Description of Artificial Sequence: Synthetic iRNA agent targeting human EGLN1 oligonucleotide
acaguggcguaucaggucg

SEQ ID NO: 891 - RNA, 19 nt, Artificial Sequence
  Description of Artificial Sequence: Synthetic iRNA agent targeting human EGLN1 oligonucleotide
gaccugauacgccacugua

SEQ ID NO: 892 - RNA, 19 nt, Artificial Sequence
  Description of Artificial Sequence: Synthetic iRNA agent targeting human EGLN1 oligonucleotide
uacaguggcguaucagguc

SEQ ID NO: 893 - RNA, 19 nt, Artificial Sequence
  Description of Artificial Sequence: Synthetic iRNA agent targeting human EGLN1 oligonucleotide
auacgccacuguaacggga

SEQ ID NO: 894 - RNA, 19 nt, Artificial Sequence
  Description of Artificial Sequence: Synthetic iRNA agent targeting human EGLN1 oligonucleotide
ucccguuacaguggcguau

SEQ ID NO: 895 - RNA, 19 nt, Artificial Sequence
  Description of Artificial Sequence: Synthetic iRNA agent targeting human EGLN1 oligonucleotide
uacaaaaucaauggccgga

SEQ ID NO: 896 - RNA, 19 nt, Artificial Sequence
  Description of Artificial Sequence: Synthetic iRNA agent targeting human EGLN1 oligonucleotide
uccggccauugauuuugua

SEQ ID NO: 897 - RNA, 19 nt, Artificial Sequence
  Description of Artificial Sequence: Synthetic iRNA agent targeting human EGLN1 oligonucleotide
aaaucaauggccggacgaa

SEQ ID NO: 898 - RNA, 19 nt, Artificial Sequence
  Description of Artificial Sequence: Synthetic iRNA agent targeting human EGLN1 oligonucleotide
uucguccggccauugauuu

SEQ ID NO: 899 - RNA, 19 nt, Artificial Sequence
  Description of Artificial Sequence: Synthetic iRNA agent targeting human EGLN1 oligonucleotide
aaucaauggccggacgaaa

SEQ ID NO: 900 - RNA, 19 nt, Artificial Sequence
  Description of Artificial Sequence: Synthetic iRNA agent targeting human EGLN1 oligonucleotide
uuucguccggccauugauu

SEQ ID NO: 901 - RNA, 19 nt, Artificial Sequence
  Description of Artificial Sequence: Synthetic iRNA agent targeting human EGLN1 oligonucleotide
aauggccggacgaaagcca

SEQ ID NO: 902 - RNA, 19 nt, Artificial Sequence
  Description of Artificial Sequence: Synthetic iRNA agent targeting human EGLN1 oligonucleotide
uggcuuucguccggccauu

SEQ ID NO: 903 - RNA, 19 nt, Artificial Sequence
  Description of Artificial Sequence: Synthetic iRNA agent targeting human EGLN1 oligonucleotide
gccggacgaaagccauggu

SEQ ID NO: 904 - RNA, 19 nt, Artificial Sequence
  Description of Artificial Sequence: Synthetic iRNA agent targeting human EGLN1 oligonucleotide
accauggcuuucguccggc

SEQ ID NO: 905 - RNA, 19 nt, Artificial Sequence
  Description of Artificial Sequence: Synthetic iRNA agent targeting human EGLN1 oligonucleotide
ccggacgaaagccaugguu

SEQ ID NO: 906 - RNA, 19 nt, Artificial Sequence
  Description of Artificial Sequence: Synthetic iRNA agent targeting human EGLN1 oligonucleotide
aaccauggcuuucguccgg

SEQ ID NO: 907 - RNA, 19 nt, Artificial Sequence
  Description of Artificial Sequence: Synthetic iRNA agent targeting human EGLN1 oligonucleotide
agccaugguugcuuguuau

SEQ ID NO: 908 - RNA, 19 nt, Artificial Sequence
  Description of Artificial Sequence: Synthetic iRNA agent targeting human EGLN1 oligonucleotide
auaacaagcaaccauggcu

SEQ ID NO: 909 - RNA, 19 nt, Artificial Sequence
  Description of Artificial Sequence: Synthetic iRNA agent targeting human EGLN1 oligonucleotide
guugcuuguuauccgggca

SEQ ID NO: 910 - RNA, 19 nt, Artificial Sequence
  Description of Artificial Sequence: Synthetic iRNA agent targeting human EGLN1 oligonucleotide
ugcccggauaacaagcaac

SEQ ID NO: 911 - RNA, 19 nt, Artificial Sequence
  Description of Artificial Sequence: Synthetic iRNA agent targeting human EGLN1 oligonucleotide
uugcuuguuauccgggcaa

SEQ ID NO: 912 - RNA, 19 nt, Artificial Sequence
  Description of Artificial Sequence: Synthetic iRNA agent targeting human EGLN1 oligonucleotide
uugcccggauaacaagcaa

SEQ ID NO: 913 - RNA, 19 nt, Artificial Sequence
  Description of Artificial Sequence: Synthetic iRNA agent targeting human EGLN1 oligonucleotide
ccgggcaauggaacggguu

SEQ ID NO: 914 - RNA, 19 nt, Artificial Sequence
  Description of Artificial Sequence: Synthetic iRNA agent targeting human EGLN1 oligonucleotide
aacccguuccauugcccgg

SEQ ID NO: 915 - RNA, 19 nt, Artificial Sequence
  Description of Artificial Sequence: Synthetic iRNA agent targeting human EGLN1 oligonucleotide
cgggcaauggaacggguua

SEQ ID NO: 916 - RNA, 19 nt, Artificial Sequence
  Description of Artificial Sequence: Synthetic iRNA agent targeting human EGLN1 oligonucleotide
uaacccguuccauugcccg

SEQ ID NO: 917 - RNA, 19 nt, Artificial Sequence
  Description of Artificial Sequence: Synthetic iRNA agent targeting human EGLN1 oligonucleotide
gggcaauggaacggguuau

SEQ ID NO: 918 - RNA, 19 nt, Artificial Sequence
  Description of Artificial Sequence: Synthetic iRNA agent targeting human EGLN1 oligonucleotide
auaacccguuccauugccc

SEQ ID NO: 919 - RNA, 19 nt, Artificial Sequence
  Description of Artificial Sequence: Synthetic iRNA agent targeting human EGLN1 oligonucleotide
gcaauggaacggguuaugu

SEQ ID NO: 920 - RNA, 19 nt, Artificial Sequence
  Description of Artificial Sequence: Synthetic iRNA agent targeting human EGLN1 oligonucleotide
acauaacccguuccauugc

SEQ ID NO: 921 - RNA, 19 nt, Artificial Sequence
  Description of Artificial Sequence: Synthetic iRNA agent targeting human EGLN1 oligonucleotide
gaacggguuauguacguca

SEQ ID NO: 922 - RNA, 19 nt, Artificial Sequence
  Description of Artificial Sequence: Synthetic iRNA agent targeting human EGLN1 oligonucleotide
ugacguacauaacccguuc

SEQ ID NO: 923 - RNA, 19 nt, Artificial Sequence
  Description of Artificial Sequence: Synthetic iRNA agent targeting human EGLN1 oligonucleotide
aacggguuauguacgucau

SEQ ID NO: 924 - RNA, 19 nt, Artificial Sequence
  Description of Artificial Sequence: Synthetic iRNA agent targeting human EGLN1 oligonucleotide
augacguacauaacccguu

SEQ ID NO: 925 - RNA, 19 nt, Artificial Sequence
  Description of Artificial Sequence: Synthetic iRNA agent targeting human EGLN1 oligonucleotide
cggguuauguacgucaugu

SEQ ID NO: 926 - RNA, 19 nt, Artificial Sequence
  Description of Artificial Sequence: Synthetic iRNA agent targeting human EGLN1 oligonucleotide
acaugacguacauaacccg

SEQ ID NO: 927 - RNA, 19 nt, Artificial Sequence
  Description of Artificial Sequence: Synthetic iRNA agent targeting human EGLN1 oligonucleotide
ggguuauguacgucauguu

SEQ ID NO: 928 - RNA, 19 nt, Artificial Sequence
  Description of Artificial Sequence: Synthetic iRNA agent targeting human EGLN1 oligonucleotide
aacaugacguacauaaccc

SEQ ID NO: 929 - RNA, 19 nt, Artificial Sequence
  Description of Artificial Sequence: Synthetic iRNA agent targeting human EGLN1 oligonucleotide
guuauguacgucauguuga

SEQ ID NO: 930 - RNA, 19 nt, Artificial Sequence
  Description of Artificial Sequence: Synthetic iRNA agent targeting human EGLN1 oligonucleotide
ucaacaugacguacauaac

SEQ ID NO: 931 - RNA, 19 nt, Artificial Sequence
  Description of Artificial Sequence: Synthetic iRNA agent targeting human EGLN1 oligonucleotide
uauguacgucauguugaua

SEQ ID NO: 932 - RNA, 19 nt, Artificial Sequence
  Description of Artificial Sequence: Synthetic iRNA agent targeting human EGLN1 oligonucleotide
uaucaacaugacguacaua

SEQ ID NO: 933 - RNA, 19 nt, Artificial Sequence
  Description of Artificial Sequence: Synthetic iRNA agent targeting human EGLN1 oligonucleotide
auguacgucauguugauaa

SEQ ID NO: 934 - RNA, 19 nt, Artificial Sequence
  Description of Artificial Sequence: Synthetic iRNA agent targeting human EGLN1 oligonucleotide
uuaucaacaugacguacau

SEQ ID NO: 935 - RNA, 19 nt, Artificial Sequence
  Description of Artificial Sequence: Synthetic iRNA agent targeting human EGLN1 oligonucleotide
acgucauguugauaaucca

SEQ ID NO: 936 - RNA, 19 nt, Artificial Sequence
  Description of Artificial Sequence: Synthetic iRNA agent targeting human EGLN1 oligonucleotide
uggauuaucaacaugacgu

SEQ ID NO: 937 - RNA, 19 nt, Artificial Sequence
  Description of Artificial Sequence: Synthetic iRNA agent targeting human EGLN1 oligonucleotide
cgucauguugauaauccaa

SEQ ID NO: 938 - RNA, 19 nt, Artificial Sequence
  Description of Artificial Sequence: Synthetic iRNA agent targeting human EGLN1 oligonucleotide
uuggauuaucaacaugacg

SEQ ID NO: 939 - RNA, 19 nt, Artificial Sequence
  Description of Artificial Sequence: Synthetic iRNA agent targeting human EGLN1 oligonucleotide
agauggaagaugugugaca

SEQ ID NO: 940 - RNA, 19 nt, Artificial Sequence
  Description of Artificial Sequence: Synthetic iRNA agent targeting human EGLN1 oligonucleotide
ugucacacaucuuccaucu

SEQ ID NO: 941 - RNA, 19 nt, Artificial Sequence
  Description of Artificial Sequence: Synthetic iRNA agent targeting human EGLN1 oligonucleotide
ugacauguauauauuaucu

SEQ ID NO: 942 - RNA, 19 nt, Artificial Sequence
  Description of Artificial Sequence: Synthetic iRNA agent targeting human EGLN1 oligonucleotide
agauaauauauacauguca

SEQ ID NO: 943 - RNA, 19 nt, Artificial Sequence
  Description of Artificial Sequence: Synthetic iRNA agent targeting human EGLN1 oligonucleotide
gacugggaugccaagguaa

SEQ ID NO: 944 - RNA, 19 nt, Artificial Sequence
  Description of Artificial Sequence: Synthetic iRNA agent targeting human EGLN1 oligonucleotide
uuaccuuggcaucccaguc

SEQ ID NO: 945 - RNA, 19 nt, Artificial Sequence
  Description of Artificial Sequence: Synthetic iRNA agent targeting human EGLN1 oligonucleotide
ccaagguaaguggagguau

SEQ ID NO: 946 - RNA, 19 nt, Artificial Sequence
  Description of Artificial Sequence: Synthetic iRNA agent targeting human EGLN1 oligonucleotide
auaccuccacuuaccuugg

SEQ ID NO: 947 - RNA, 19 nt, Artificial Sequence
  Description of Artificial Sequence: Synthetic iRNA agent targeting human EGLN1 oligonucleotide
guggagguauacuucgaau

SEQ ID NO: 948 - RNA, 19 nt, Artificial Sequence
  Description of Artificial Sequence: Synthetic iRNA agent targeting human EGLN1 oligonucleotide
auucgaaguauaccuccac

SEQ ID NO: 949 - RNA, 19 nt, Artificial Sequence
  Description of Artificial Sequence: Synthetic iRNA agent targeting human EGLN1 oligonucleotide
uggagguauacuucgaauu

SEQ ID NO: 950 - RNA, 19 nt, Artificial Sequence
  Description of Artificial Sequence: Synthetic iRNA agent targeting human EGLN1 oligonucleotide
aauucgaaguauaccucca

SEQ ID NO: 951 - RNA, 19 nt, Artificial Sequence
  Description of Artificial Sequence: Synthetic iRNA agent targeting human EGLN1 oligonucleotide
ggagguauacuucgaauuu

SEQ ID NO: 952 - RNA, 19 nt, Artificial Sequence
  Description of Artificial Sequence: Synthetic iRNA agent targeting human EGLN1 oligonucleotide
aaauucgaaguauaccucc

SEQ ID NO: 953 - RNA, 19 nt, Artificial Sequence
  Description of Artificial Sequence: Synthetic iRNA agent targeting human EGLN1 oligonucleotide
gagguauacuucgaauuuu

SEQ ID NO: 954 - RNA, 19 nt, Artificial Sequence
  Description of Artificial Sequence: Synthetic iRNA agent targeting human EGLN1 oligonucleotide
aaaauucgaaguauaccuc

SEQ ID NO: 955 - RNA, 19 nt, Artificial Sequence
  Description of Artificial Sequence: Synthetic iRNA agent targeting human EGLN1 oligonucleotide
uucuggucugaccgucgca

SEQ ID NO: 956 - RNA, 19 nt, Artificial Sequence
  Description of Artificial Sequence: Synthetic iRNA agent targeting human EGLN1 oligonucleotide
ugcgacggucagaccagaa

SEQ ID NO: 957 - RNA, 19 nt, Artificial Sequence
  Description of Artificial Sequence: Synthetic iRNA agent targeting human EGLN1 oligonucleotide
ucuggucugaccgucgcaa

SEQ ID NO: 958 - RNA, 19 nt, Artificial Sequence
  Description of Artificial Sequence: Synthetic iRNA agent targeting human EGLN1 oligonucleotide
uugcgacggucagaccaga

SEQ ID NO: 959 - RNA, 19 nt, Artificial Sequence
  Description of Artificial Sequence: Synthetic iRNA agent targeting human EGLN1 oligonucleotide
gucugaccgucgcaacccu

SEQ ID NO: 960 - RNA, 19 nt, Artificial Sequence
  Description of Artificial Sequence: Synthetic iRNA agent targeting human EGLN1 oligonucleotide
aggguugcgacggucagac

SEQ ID NO: 961 - RNA, 19 nt, Artificial Sequence
  Description of Artificial Sequence: Synthetic iRNA agent targeting human EGLN1 oligonucleotide
caacccucaugaaguacaa

SEQ ID NO: 962 - RNA, 19 nt, Artificial Sequence
  Description of Artificial Sequence: Synthetic iRNA agent targeting human EGLN1 oligonucleotide
uuguacuucaugaggguug

SEQ ID NO: 963 - RNA, 19 nt, Artificial Sequence
  Description of Artificial Sequence: Synthetic iRNA agent targeting human EGLN1 oligonucleotide
uaugcuacaagguacgcaa

SEQ ID NO: 964 - RNA, 19 nt, Artificial Sequence
  Description of Artificial Sequence: Synthetic iRNA agent targeting human EGLN1 oligonucleotide
uugcguaccuuguagcaua

SEQ ID NO: 965 - RNA, 19 nt, Artificial Sequence
  Description of Artificial Sequence: Synthetic iRNA agent targeting human EGLN1 oligonucleotide
augcuacaagguacgcaau

SEQ ID NO: 966 - RNA, 19 nt, Artificial Sequence
  Description of Artificial Sequence: Synthetic iRNA agent targeting human EGLN1 oligonucleotide
auugcguaccuuguagcau

SEQ ID NO: 967 - RNA, 19 nt, Artificial Sequence
  Description of Artificial Sequence: Synthetic iRNA agent targeting human EGLN1 oligonucleotide
ugcuacaagguacgcaaua

SEQ ID NO: 968 - RNA, 19 nt, Artificial Sequence
  Description of Artificial Sequence: Synthetic iRNA agent targeting human EGLN1 oligonucleotide
uauugcguaccuuguagca

SEQ ID NO: 969 - RNA, 19 nt, Artificial Sequence
  Description of Artificial Sequence: Synthetic iRNA agent targeting human EGLN1 oligonucleotide
gcuacaagguacgcaauaa

SEQ ID NO: 970 - RNA, 19 nt, Artificial Sequence
  Description of Artificial Sequence: Synthetic iRNA agent targeting human EGLN1 oligonucleotide
uuauugcguaccuuguagc

SEQ ID NO: 971 - RNA, 19 nt, Artificial Sequence
  Description of Artificial Sequence: Synthetic iRNA agent targeting human EGLN1 oligonucleotide
uacaagguacgcaauaacu

SEQ ID NO: 972 - RNA, 19 nt, Artificial Sequence
  Description of Artificial Sequence: Synthetic iRNA agent targeting human EGLN1 oligonucleotide
aguuauugcguaccuugua

SEQ ID NO: 973 - RNA, 19 nt, Artificial Sequence
  Description of Artificial Sequence: Synthetic iRNA agent targeting human EGLN1 oligonucleotide
uacgcaauaacuguuuggu

SEQ ID NO: 974 - RNA, 19 nt, Artificial Sequence
  Description of Artificial Sequence: Synthetic iRNA agent targeting human EGLN1 oligonucleotide
accaaacaguuauugcgua

SEQ ID NO: 975 - RNA, 19 nt, Artificial Sequence
  Description of Artificial Sequence: Synthetic iRNA agent targeting human EGLN1 oligonucleotide
acgcaauaacuguuuggua

SEQ ID NO: 976 - RNA, 19 nt, Artificial Sequence
  Description of Artificial Sequence: Synthetic iRNA agent targeting human EGLN1 oligonucleotide
uaccaaacaguuauugcgu

SEQ ID NO: 977 - RNA, 19 nt, Artificial Sequence
  Description of Artificial Sequence: Synthetic iRNA agent targeting human EGLN1 oligonucleotide
agaugagagagcacgagcu

SEQ ID NO: 978 - RNA, 19 nt, Artificial Sequence
  Description of Artificial Sequence: Synthetic iRNA agent targeting human EGLN1 oligonucleotide
agcucgugcucucucaucu

SEQ ID NO: 979 - RNA, 19 nt, Artificial Sequence
  Description of Artificial Sequence: Synthetic iRNA agent targeting human EGLN1 oligonucleotide
augagagagcacgagcuaa

SEQ ID NO: 980 - RNA, 19 nt, Artificial Sequence
  Description of Artificial Sequence: Synthetic iRNA agent targeting human EGLN1 oligonucleotide
uuagcucgugcucucucau

SEQ ID NO: 981 - RNA, 19 nt, Artificial Sequence
  Description of Artificial Sequence: Synthetic iRNA agent targeting human EGLN1 oligonucleotide
agagagcacgagcuaaagu

SEQ ID NO: 982 - RNA, 19 nt, Artificial Sequence
  Description of Artificial Sequence: Synthetic iRNA agent targeting human EGLN1 oligonucleotide
acuuuagcucgugcucucu

SEQ ID NO: 983 - RNA, 19 nt, Artificial Sequence
  Description of Artificial Sequence: Synthetic iRNA agent targeting human EGLN1 oligonucleotide
gagagcacgagcuaaagua

SEQ ID NO: 984 - RNA, 19 nt, Artificial Sequence
  Description of Artificial Sequence: Synthetic iRNA agent targeting human EGLN1 oligonucleotide
uacuuuagcucgugcucuc

SEQ ID NO: 985 - RNA, 19 nt, Artificial Sequence
  Description of Artificial Sequence: Synthetic iRNA agent targeting human EGLN1 oligonucleotide
agagcacgagcuaaaguaa

SEQ ID NO: 986 - RNA, 19 nt, Artificial Sequence
  Description of Artificial Sequence: Synthetic iRNA agent targeting human EGLN1 oligonucleotide
uuacuuuagcucgugcucu

SEQ ID NO: 987 - RNA, 19 nt, Artificial Sequence
  Description of Artificial Sequence: Synthetic iRNA agent targeting human EGLN1 oligonucleotide
aguaaaauaucuaacaggu

SEQ ID NO: 988 - RNA, 19 nt, Artificial Sequence
  Description of Artificial Sequence: Synthetic iRNA agent targeting human EGLN1 oligonucleotide
accuguuagauauuuuacu

SEQ ID NO: 989 - RNA, 19 nt, Artificial Sequence
  Description of Artificial Sequence: Synthetic iRNA agent targeting human EGLN1 oligonucleotide
uaaaauaucuaacagguga

SEQ ID NO: 990 - RNA, 19 nt, Artificial Sequence
  Description of Artificial Sequence: Synthetic iRNA agent targeting human EGLN1 oligonucleotide
ucaccuguuagauauuuua

SEQ ID NO: 991 - RNA, 19 nt, Artificial Sequence
  Description of Artificial Sequence: Synthetic iRNA agent targeting human EGLN1 oligonucleotide
aaaauaucuaacaggugaa

SEQ ID NO: 992 - RNA, 19 nt, Artificial Sequence
  Description of Artificial Sequence: Synthetic iRNA agent targeting human EGLN1 oligonucleotide
uucaccuguuagauauuuu

SEQ ID NO: 993 - RNA, 19 nt, Artificial Sequence
  Description of Artificial Sequence: Synthetic iRNA agent targeting human EGLN1 oligonucleotide
aaauaucuaacaggugaaa

SEQ ID NO: 994 - RNA, 19 nt, Artificial Sequence
  Description of Artificial Sequence: Synthetic iRNA agent targeting human EGLN1 oligonucleotide
uuucaccuguuagauauuu

SEQ ID NO: 995 - RNA, 19 nt, Artificial Sequence
  Description of Artificial Sequence: Synthetic iRNA agent targeting human EGLN1 oligonucleotide
aaggugugaggguugaacu

SEQ ID NO: 996 - RNA, 19 nt, Artificial Sequence
  Description of Artificial Sequence: Synthetic iRNA agent targeting human EGLN1 oligonucleotide
aguucaacccucacaccuu

SEQ ID NO: 997 - RNA, 19 nt, Artificial Sequence
  Description of Artificial Sequence: Synthetic iRNA agent targeting human EGLN1 oligonucleotide
ggugugaggguugaacuca

SEQ ID NO: 998 - RNA, 19 nt, Artificial Sequence
  Description of Artificial Sequence: Synthetic iRNA agent targeting human EGLN1 oligonucleotide
ugaguucaacccucacacc

SEQ ID NO: 999 - RNA, 19 nt, Artificial Sequence
  Description of Artificial Sequence: Synthetic iRNA agent targeting human EGLN1 oligonucleotide
gugaggguugaacucaaua

SEQ ID NO: 1000 - RNA, 19 nt, Artificial Sequence
  Description of Artificial Sequence: Synthetic iRNA agent targeting human EGLN1 oligonucleotide
uauugaguucaacccucac

SEQ ID NO: 1001 - RNA, 19 nt, Artificial Sequence
  Description of Artificial Sequence: Synthetic iRNA agent targeting human EGLN1 oligonucleotide
gaggguugaacucaauaaa

SEQ ID NO: 1002 - RNA, 19 nt, Artificial Sequence
  Description of Artificial Sequence: Synthetic iRNA agent targeting human EGLN1 oligonucleotide
uuuauugaguucaacccuc

SEQ ID NO: 1003 - RNA, 19 nt, Artificial Sequence
  Description of Artificial Sequence: Synthetic iRNA agent targeting human EGLN1 oligonucleotide
gguugaacucaauaaaccu

SEQ ID NO: 1004 - RNA, 19 nt, Artificial Sequence
  Description of Artificial Sequence: Synthetic iRNA agent targeting human EGLN1 oligonucleotide
agguuuauugaguucaacc

SEQ ID NO: 1005 - RNA, 19 nt, Artificial Sequence
  Description of Artificial Sequence: Synthetic iRNA agent targeting human EGLN1 oligonucleotide
accuucagauucggucggu

SEQ ID NO: 1006 - RNA, 19 nt, Artificial Sequence
  Description of Artificial Sequence: Synthetic iRNA agent targeting human EGLN1 oligonucleotide
accgaccgaaucugaaggu

SEQ ID NO: 1007 - RNA, 19 nt, Artificial Sequence
  Description of Artificial Sequence: Synthetic iRNA agent targeting human EGLN1 oligonucleotide
ccuucagauucggucggua

SEQ ID NO: 1008 - RNA, 19 nt, Artificial Sequence
  Description of Artificial Sequence: Synthetic iRNA agent targeting human EGLN1 oligonucleotide
uaccgaccgaaucugaagg

SEQ ID NO: 1009 - RNA, 19 nt, Artificial Sequence
  Description of Artificial Sequence: Synthetic iRNA agent targeting human EGLN1 oligonucleotide
cuucagauucggucgguaa

SEQ ID NO: 1010 - RNA, 19 nt, Artificial Sequence
  Description of Artificial Sequence: Synthetic iRNA agent targeting human EGLN1 oligonucleotide
uuaccgaccgaaucugaag

SEQ ID NO: 1011 - RNA, 19 nt, Artificial Sequence
  Description of Artificial Sequence: Synthetic iRNA agent targeting human EGLN1 oligonucleotide
uucagauucggucgguaaa

SEQ ID NO: 1012 - RNA, 19 nt, Artificial Sequence
  Description of Artificial Sequence: Synthetic iRNA agent targeting human EGLN1 oligonucleotide
uuuaccgaccgaaucugaa

SEQ ID NO: 1013 - RNA, 19 nt, Artificial Sequence
  Description of Artificial Sequence: Synthetic iRNA agent targeting human EGLN1 oligonucleotide
cagauucggucgguaaaga

SEQ ID NO: 1014 - RNA, 19 nt, Artificial Sequence
  Description of Artificial Sequence: Synthetic iRNA agent targeting human EGLN1 oligonucleotide
ucuuuaccgaccgaaucug

SEQ ID NO: 1015 - RNA, 19 nt, Artificial Sequence
  Description of Artificial Sequence: Synthetic iRNA agent targeting human EGLN1 oligonucleotide
auucggucgguaaagacgu

SEQ ID NO: 1016 - RNA, 19 nt, Artificial Sequence
  Description of Artificial Sequence: Synthetic iRNA agent targeting human EGLN1 oligonucleotide
acgucuuuaccgaccgaau

SEQ ID NO: 1017 - RNA, 19 nt, Artificial Sequence
  Description of Artificial Sequence: Synthetic iRNA agent targeting human EGLN1 oligonucleotide
aagacgucuucuagagccu

SEQ ID NO: 1018 - RNA, 19 nt, Artificial Sequence
  Description of Artificial Sequence: Synthetic iRNA agent targeting human EGLN1 oligonucleotide
aggcucuagaagacgucuu

SEQ ID NO: 1019 - RNA, 19 nt, Artificial Sequence
  Description of Artificial Sequence: Synthetic iRNA agent targeting human EGLN1 oligonucleotide
agacgucuucuagagccuu

SEQ ID NO: 1020 - RNA, 19 nt, Artificial Sequence
  Description of Artificial Sequence: Synthetic iRNA agent targeting human EGLN1 oligonucleotide
aaggcucuagaagacgucu

SEQ ID NO: 1021 - RNA, 19 nt, Artificial Sequence
  Description of Artificial Sequence: Synthetic iRNA agent targeting human EGLN1 oligonucleotide
uagagccuuugauccagca

SEQ ID NO: 1022 - RNA, 19 nt, Artificial Sequence
  Description of Artificial Sequence: Synthetic iRNA agent targeting human EGLN1 oligonucleotide
ugcuggaucaaaggcucua

SEQ ID NO: 1023 - RNA, 19 nt, Artificial Sequence
  Description of Artificial Sequence: Synthetic iRNA agent targeting human EGLN1 oligonucleotide
uugauccagcaauacccca

SEQ ID NO: 1024 - RNA, 19 nt, Artificial Sequence
  Description of Artificial Sequence: Synthetic iRNA agent targeting human EGLN1 oligonucleotide
ugggguauugcuggaucaa

SEQ ID NO: 1025 - RNA, 19 nt, Artificial Sequence
  Description of Artificial Sequence: Synthetic iRNA agent targeting human EGLN1 oligonucleotide
gcaauaccccacuucaccu

SEQ ID NO: 1026 - RNA, 19 nt, Artificial Sequence
  Description of Artificial Sequence: Synthetic iRNA agent targeting human EGLN1 oligonucleotide
aggugaagugggguauugc

SEQ ID NO: 1027 - RNA, 19 nt, Artificial Sequence
  Description of Artificial Sequence: Synthetic iRNA agent targeting human EGLN1 oligonucleotide
acuucaccuacaauauugu

SEQ ID NO: 1028 - RNA, 19 nt, Artificial Sequence
  Description of Artificial Sequence: Synthetic iRNA agent targeting human EGLN1 oligonucleotide
acaauauuguaggugaagu

SEQ ID NO: 1029 - RNA, 19 nt, Artificial Sequence
  Description of Artificial Sequence: Synthetic iRNA agent targeting human EGLN1 oligonucleotide
uguuaacuugugaauacga

SEQ ID NO: 1030 - RNA, 19 nt, Artificial Sequence
  Description of Artificial Sequence: Synthetic iRNA agent targeting human EGLN1 oligonucleotide
ucguauucacaaguuaaca

SEQ ID NO: 1031 - RNA, 19 nt, Artificial Sequence
  Description of Artificial Sequence: Synthetic iRNA agent targeting human EGLN1 oligonucleotide
guuaacuugugaauacgaa

SEQ ID NO: 1032 - RNA, 19 nt, Artificial Sequence
  Description of Artificial Sequence: Synthetic iRNA agent targeting human EGLN1 oligonucleotide
uucguauucacaaguuaac

SEQ ID NO: 1033 - RNA, 19 nt, Artificial Sequence
  Description of Artificial Sequence: Synthetic iRNA agent targeting human EGLN1 oligonucleotide
cuugugaauacgaauaaau

SEQ ID NO: 1034 - RNA, 19 nt, Artificial Sequence
  Description of Artificial Sequence: Synthetic iRNA agent targeting human EGLN1 oligonucleotide
auuuauucguauucacaag

SEQ ID NO: 1035 - RNA, 19 nt, Artificial Sequence
  Description of Artificial Sequence: Synthetic iRNA agent targeting human EGLN1 oligonucleotide
uacgaauaaaugggauaaa

SEQ ID NO: 1036 - RNA, 19 nt, Artificial Sequence
  Description of Artificial Sequence: Synthetic iRNA agent targeting human EGLN1 oligonucleotide
uuuaucccauuuauucgua

SEQ ID NO: 1037 - RNA, 19 nt, Artificial Sequence
  Description of Artificial Sequence: Synthetic iRNA agent targeting human EGLN1 oligonucleotide
aauagacaaccaguucgca

SEQ ID NO: 1038 - RNA, 19 nt, Artificial Sequence
  Description of Artificial Sequence: Synthetic iRNA agent targeting human EGLN1 oligonucleotide
ugcgaacugguugucuauu

SEQ ID NO: 1039 - RNA, 19 nt, Artificial Sequence
  Description of Artificial Sequence: Synthetic iRNA agent targeting human EGLN1 oligonucleotide
auagacaaccaguucgcau

SEQ ID NO: 1040 - RNA, 19 nt, Artificial Sequence
  Description of Artificial Sequence: Synthetic iRNA agent targeting human EGLN1 oligonucleotide
augcgaacugguugucuau

SEQ ID NO: 1041 - RNA, 19 nt, Artificial Sequence
  Description of Artificial Sequence: Synthetic iRNA agent targeting human EGLN1 oligonucleotide
uagacaaccaguucgcauu

SEQ ID NO: 1042 - RNA, 19 nt, Artificial Sequence
  Description of Artificial Sequence: Synthetic iRNA agent targeting human EGLN1 oligonucleotide
aaugcgaacugguugucua

SEQ ID NO: 1043 - RNA, 19 nt, Artificial Sequence
  Description of Artificial Sequence: Synthetic iRNA agent targeting human EGLN1 oligonucleotide
agacaaccaguucgcauuu

SEQ ID NO: 1044 - RNA, 19 nt, Artificial Sequence
  Description of Artificial Sequence: Synthetic iRNA agent targeting human EGLN1 oligonucleotide
aaaugcgaacugguugucu

SEQ ID NO: 1045 - RNA, 19 nt, Artificial Sequence
  Description of Artificial Sequence: Synthetic iRNA agent targeting human EGLN1 oligonucleotide
cuuuguacugcaugaucaa

SEQ ID NO: 1046 - RNA, 19 nt, Artificial Sequence
  Description of Artificial Sequence: Synthetic iRNA agent targeting human EGLN1 oligonucleotide
uugaucaugcaguacaaag

SEQ ID NO: 1047 - RNA, 19 nt, Artificial Sequence
  Description of Artificial Sequence: Synthetic iRNA agent targeting human EGLN1 oligonucleotide
ucugugauugcuuacagga

SEQ ID NO: 1048 - RNA, 19 nt, Artificial Sequence
  Description of Artificial Sequence: Synthetic iRNA agent targeting human EGLN1 oligonucleotide
uccuguaagcaaucacaga

SEQ ID NO: 1049 - RNA, 19 nt, Artificial Sequence
  Description of Artificial Sequence: Synthetic iRNA agent targeting human EGLN1 oligonucleotide
gaggaagauaagcuacuaa

SEQ ID NO: 1050 - RNA, 19 nt, Artificial Sequence
  Description of Artificial Sequence: Synthetic iRNA agent targeting human EGLN1 oligonucleotide
uuaguagcuuaucuuccuc

SEQ ID NO: 1051 - RNA, 19 nt, Artificial Sequence
  Description of Artificial Sequence: Synthetic iRNA agent targeting human EGLN1 oligonucleotide
aucuggauaugaaauaagu

SEQ ID NO: 1052 - RNA, 19 nt, Artificial Sequence
  Description of Artificial Sequence: Synthetic iRNA agent targeting human EGLN1 oligonucleotide
acuuauuucauauccagau

SEQ ID NO: 1053 - RNA, 19 nt, Artificial Sequence
  Description of Artificial Sequence: Synthetic iRNA agent targeting human EGLN1 oligonucleotide
aauaagugcccuguguaga

SEQ ID NO: 1054 - RNA, 19 nt, Artificial Sequence
  Description of Artificial Sequence: Synthetic iRNA agent targeting human EGLN1 oligonucleotide
ucuacacagggcacuuauu

SEQ ID NO: 1055 - RNA, 19 nt, Artificial Sequence
  Description of Artificial Sequence: Synthetic iRNA agent targeting human EGLN1 oligonucleotide
auaagugcccuguguagaa

SEQ ID NO: 1056 - RNA, 19 nt, Artificial Sequence
  Description of Artificial Sequence: Synthetic iRNA agent targeting human EGLN1 oligonucleotide
uucuacacagggcacuuau

SEQ ID NO: 1057 - RNA, 19 nt, Artificial Sequence
  Description of Artificial Sequence: Synthetic iRNA agent targeting human EGLN1 oligonucleotide
agugcccuguguagaauuu

SEQ ID NO: 1058 - RNA, 19 nt, Artificial Sequence
  Description of Artificial Sequence: Synthetic iRNA agent targeting human EGLN1 oligonucleotide
aaauucuacacagggcacu

SEQ ID NO: 1059 - RNA, 19 nt, Artificial Sequence
  Description of Artificial Sequence: Synthetic iRNA agent targeting human EGLN1 oligonucleotide
uauauuuugccagaucugu

SEQ ID NO: 1060 - RNA, 19 nt, Artificial Sequence
  Description of Artificial Sequence: Synthetic iRNA agent targeting human EGLN1 oligonucleotide
acagaucuggcaaaauaua

SEQ ID NO: 1061 - RNA, 19 nt, Artificial Sequence
  Description of Artificial Sequence: Synthetic iRNA agent targeting human EGLN1 oligonucleotide
uugccagaucuguuaucua

SEQ ID NO: 1062 - RNA, 19 nt, Artificial Sequence
  Description of Artificial Sequence: Synthetic iRNA agent targeting human EGLN1 oligonucleotide
uagauaacagaucuggcaa

SEQ ID NO: 1063 - RNA, 19 nt, Artificial Sequence
  Description of Artificial Sequence: Synthetic iRNA agent targeting human EGLN1 oligonucleotide
ccagaucuguuaucuagcu

SEQ ID NO: 1064 - RNA, 19 nt, Artificial Sequence
  Description of Artificial Sequence: Synthetic iRNA agent targeting human EGLN1 oligonucleotide
agcuagauaacagaucugg

SEQ ID NO: 1065 - RNA, 19 nt, Artificial Sequence
  Description of Artificial Sequence: Synthetic iRNA agent targeting human EGLN1 oligonucleotide
uguuaucuagcugaguuca

SEQ ID NO: 1066 - RNA, 19 nt, Artificial Sequence
  Description of Artificial Sequence: Synthetic iRNA agent targeting human EGLN1 oligonucleotide
ugaacucagcuagauaaca

SEQ ID NO: 1067 - RNA, 19 nt, Artificial Sequence
  Description of Artificial Sequence: Synthetic iRNA agent targeting human EGLN1 oligonucleotide
guuaucuagcugaguucau

SEQ ID NO: 1068 - RNA, 19 nt, Artificial Sequence
  Description of Artificial Sequence: Synthetic iRNA agent targeting human EGLN1 oligonucleotide
augaacucagcuagauaac

SEQ ID NO: 1069 - RNA, 19 nt, Artificial Sequence
  Description of Artificial Sequence: Synthetic iRNA agent targeting human EGLN1 oligonucleotide
agcugaguucauuucaucu

SEQ ID NO: 1070 - RNA, 19 nt, Artificial Sequence
  Description of Artificial Sequence: Synthetic iRNA agent targeting human EGLN1 oligonucleotide
agaugaaaugaacucagcu

SEQ ID NO: 1071 - RNA, 19 nt, Artificial Sequence
  Description of Artificial Sequence: Synthetic iRNA agent targeting human EGLN1 oligonucleotide
aaguuugaauuugggauaa

SEQ ID NO: 1072 - RNA, 19 nt, Artificial Sequence
  Description of Artificial Sequence: Synthetic iRNA agent targeting human EGLN1 oligonucleotide
uuaucccaaauucaaacuu

SEQ ID NO: 1073 - RNA, 19 nt, Artificial Sequence
  Description of Artificial Sequence: Synthetic iRNA agent targeting human EGLN1 oligonucleotide
uuucuauauuagguacaau

SEQ ID NO: 1074 - RNA, 19 nt, Artificial Sequence
  Description of Artificial Sequence: Synthetic iRNA agent targeting human EGLN1 oligonucleotide
auuguaccuaauauagaaa

SEQ ID NO: 1075 - RNA, 19 nt, Artificial Sequence
  Description of Artificial Sequence: Synthetic iRNA agent targeting human EGLN1 oligonucleotide
ucuauauuagguacaauuu

SEQ ID NO: 1076 - RNA, 19 nt, Artificial Sequence
  Description of Artificial Sequence: Synthetic iRNA agent targeting human EGLN1 oligonucleotide
aaauuguaccuaauauaga

SEQ ID NO: 1077 - RNA, 19 nt, Artificial Sequence
  Description of Artificial Sequence: Synthetic iRNA agent targeting human EGLN1 oligonucleotide
auuagguacaauuuaucua

SEQ ID NO: 1078 - RNA, 19 nt, Artificial Sequence
  Description of Artificial Sequence: Synthetic iRNA agent targeting human EGLN1 oligonucleotide
uagauaaauuguaccuaau

SEQ ID NO: 1079 - RNA, 19 nt, Artificial Sequence
  Description of Artificial Sequence: Synthetic iRNA agent targeting human EGLN1 oligonucleotide
uuagguacaauuuaucuaa

SEQ ID NO: 1080 - RNA, 19 nt, Artificial Sequence
  Description of Artificial Sequence: Synthetic iRNA agent targeting human EGLN1 oligonucleotide
uuagauaaauuguaccuaa

SEQ ID NO: 1081 - RNA, 19 nt, Artificial Sequence
  Description of Artificial Sequence: Synthetic iRNA agent targeting human EGLN1 oligonucleotide
uagguacaauuuaucuaaa

SEQ ID NO: 1082 - RNA, 19 nt, Artificial Sequence
  Description of Artificial Sequence: Synthetic iRNA agent targeting human EGLN1 oligonucleotide
uuuagauaaauuguaccua

SEQ ID NO: 1083 - RNA, 19 nt, Artificial Sequence
  Description of Artificial Sequence: Synthetic iRNA agent targeting human EGLN1 oligonucleotide
gguacaauuuaucuaaacu

SEQ ID NO: 1084 - RNA, 19 nt, Artificial Sequence
  Description of Artificial Sequence: Synthetic iRNA agent targeting human EGLN1 oligonucleotide
aguuuagauaaauuguacc

SEQ ID NO: 1085 - RNA, 19 nt, Artificial Sequence
  Description of Artificial Sequence: Synthetic iRNA agent targeting human EGLN1 oligonucleotide
cucaaaauaacaucaaucu

SEQ ID NO: 1086 - RNA, 19 nt, Artificial Sequence
  Description of Artificial Sequence: Synthetic iRNA agent targeting human EGLN1 oligonucleotide
agauugauguuauuuugag

SEQ ID NO: 1087 - RNA, 19 nt, Artificial Sequence
  Description of Artificial Sequence: Synthetic iRNA agent targeting human EGLN1 oligonucleotide
uuguaaaccuguucauacu

SEQ ID NO: 1088 - RNA, 19 nt, Artificial Sequence
  Description of Artificial Sequence: Synthetic iRNA agent targeting human EGLN1 oligonucleotide
aguaugaacagguuuacaa

SEQ ID NO: 1089 - RNA, 19 nt, Artificial Sequence
  Description of Artificial Sequence: Synthetic iRNA agent targeting human EGLN1 oligonucleotide
uguaaaccuguucauacua

SEQ ID NO: 1090 - RNA, 19 nt, Artificial Sequence
  Description of Artificial Sequence: Synthetic iRNA agent targeting human EGLN1 oligonucleotide
uaguaugaacagguuuaca

SEQ ID NO: 1091 - RNA, 19 nt, Artificial Sequence
  Description of Artificial Sequence: Synthetic iRNA agent targeting human EGLN1 oligonucleotide
aaaccuguucauacuauua

SEQ ID NO: 1092 - RNA, 19 nt, Artificial Sequence
  Description of Artificial Sequence: Synthetic iRNA agent targeting human EGLN1 oligonucleotide
uaauaguaugaacagguuu

SEQ ID NO: 1093 - RNA, 19 nt, Artificial Sequence
  Description of Artificial Sequence: Synthetic iRNA agent targeting human EGLN1 oligonucleotide
acuauuaaauuuugcccua

SEQ ID NO: 1094 - RNA, 19 nt, Artificial Sequence
  Description of Artificial Sequence: Synthetic iRNA agent targeting human EGLN1 oligonucleotide
uagggcaaaauuuaauagu

SEQ ID NO: 1095 - RNA, 19 nt, Artificial Sequence
  Description of Artificial Sequence: Synthetic iRNA agent targeting human EGLN1 oligonucleotide
uuugcccuaaaagaccucu

SEQ ID NO: 1096 - RNA, 19 nt, Artificial Sequence
  Description of Artificial Sequence: Synthetic iRNA agent targeting human EGLN1 oligonucleotide
agaggucuuuuagggcaaa

SEQ ID NO: 1097 - RNA, 19 nt, Artificial Sequence
  Description of Artificial Sequence: Synthetic iRNA agent targeting human EGLN1 oligonucleotide
uugcccuaaaagaccucuu

SEQ ID NO: 1098 - RNA, 19 nt, Artificial Sequence
  Description of Artificial Sequence: Synthetic iRNA agent targeting human EGLN1 oligonucleotide
aagaggucuuuuagggcaa

SEQ ID NO: 1099 - RNA, 19 nt, Artificial Sequence
  Description of Artificial Sequence: Synthetic iRNA agent targeting human EGLN1 oligonucleotide
aagaccucuuaauaaugau

SEQ ID NO: 1100 - RNA, 19 nt, Artificial Sequence
  Description of Artificial Sequence: Synthetic iRNA agent targeting human EGLN1 oligonucleotide
aucauuauuaagaggucuu

SEQ ID NO: 1101 - RNA, 19 nt, Artificial Sequence
  Description of Artificial Sequence: Synthetic iRNA agent targeting human EGLN1 oligonucleotide
agaccucuuaauaaugauu

SEQ ID NO: 1102 - RNA, 19 nt, Artificial Sequence
  Description of Artificial Sequence: Synthetic iRNA agent targeting human EGLN1 oligonucleotide
aaucauuauuaagaggucu

SEQ ID NO: 1103 - RNA, 19 nt, Artificial Sequence
  Description of Artificial Sequence: Synthetic iRNA agent targeting human EGLN1 oligonucleotide
ccucuuaauaaugauuguu

SEQ ID NO: 1104 - RNA, 19 nt, Artificial Sequence
  Description of Artificial Sequence: Synthetic iRNA agent targeting human EGLN1 oligonucleotide
aacaaucauuauuaagagg

SEQ ID NO: 1105 - RNA, 19 nt, Artificial Sequence
  Description of Artificial Sequence: Synthetic iRNA agent targeting human EGLN1 oligonucleotide
gccagugacugaugauuaa

SEQ ID NO: 1106 - RNA, 19 nt, Artificial Sequence
  Description of Artificial Sequence: Synthetic iRNA agent targeting human EGLN1 oligonucleotide
uuaaucaucagucacuggc

SEQ ID NO: 1107 - RNA, 19 nt, Artificial Sequence
  Description of Artificial Sequence: Synthetic iRNA agent targeting human EGLN1 oligonucleotide
ccagugacugaugauuaau

SEQ ID NO: 1108 - RNA, 19 nt, Artificial Sequence
  Description of Artificial Sequence: Synthetic iRNA agent targeting human EGLN1 oligonucleotide
auuaaucaucagucacugg

SEQ ID NO: 1109 - RNA, 19 nt, Artificial Sequence
  Description of Artificial Sequence: Synthetic iRNA agent targeting human EGLN1 oligonucleotide
cagugacugaugauuaauu

SEQ ID NO: 1110 - RNA, 19 nt, Artificial Sequence
  Description of Artificial Sequence: Synthetic iRNA agent targeting human EGLN1 oligonucleotide
aauuaaucaucagucacug

SEQ ID NO: 1111 - RNA, 19 nt, Artificial Sequence
  Description of Artificial Sequence: Synthetic iRNA agent targeting human EGLN1 oligonucleotide
gagcacuuuaauuacaacu

SEQ ID NO: 1112 - RNA, 19 nt, Artificial Sequence
  Description of Artificial Sequence: Synthetic iRNA agent targeting human EGLN1 oligonucleotide
aguuguaauuaaagugcuc

SEQ ID NO: 1113 - RNA, 19 nt, Artificial Sequence
  Description of Artificial Sequence: Synthetic iRNA agent targeting human EGLN1 oligonucleotide
uuuguaguccuuccuuaca

SEQ ID NO: 1114 - RNA, 19 nt, Artificial Sequence
  Description of Artificial Sequence: Synthetic iRNA agent targeting human EGLN1 oligonucleotide
uguaaggaaggacuacaaa

SEQ ID NO: 1115 - RNA, 19 nt, Artificial Sequence
  Description of Artificial Sequence: Synthetic iRNA agent targeting human EGLN1 oligonucleotide
uaguccuuccuuacacuaa

SEQ ID NO: 1116 - RNA, 19 nt, Artificial Sequence
  Description of Artificial Sequence: Synthetic iRNA agent targeting human EGLN1 oligonucleotide
uuaguguaaggaaggacua

SEQ ID NO: 1117 - RNA, 19 nt, Artificial Sequence
  Description of Artificial Sequence: Synthetic iRNA agent targeting human EGLN1 oligonucleotide
cacuaauuugaacuguuaa

SEQ ID NO: 1118 - RNA, 19 nt, Artificial Sequence
  Description of Artificial Sequence: Synthetic iRNA agent targeting human EGLN1 oligonucleotide
uuaacaguucaaauuagug

SEQ ID NO: 1119 - RNA, 19 nt, Artificial Sequence
  Description of Artificial Sequence: Synthetic iRNA agent targeting human EGLN1 oligonucleotide
uugacauugucaauaacga

SEQ ID NO: 1120 - RNA, 19 nt, Artificial Sequence
  Description of Artificial Sequence: Synthetic iRNA agent targeting human EGLN1 oligonucleotide
ucguuauugacaaugucaa

SEQ ID NO: 1121 - RNA, 19 nt, Artificial Sequence
  Description of Artificial Sequence: Synthetic iRNA agent targeting human EGLN1 oligonucleotide
ugacauugucaauaacgaa

SEQ ID NO: 1122 - RNA, 19 nt, Artificial Sequence
  Description of Artificial Sequence: Synthetic iRNA agent targeting human EGLN1 oligonucleotide
uucguuauugacaauguca

SEQ ID NO: 1123 - RNA, 19 nt, Artificial Sequence
  Description of Artificial Sequence: Synthetic iRNA agent targeting human EGLN1 oligonucleotide
gacauugucaauaacgaaa

SEQ ID NO: 1124 - RNA, 19 nt, Artificial Sequence
  Description of Artificial Sequence: Synthetic iRNA agent targeting human EGLN1 oligonucleotide
uuucguuauugacaauguc

SEQ ID NO: 1125 - RNA, 19 nt, Artificial Sequence
  Description of Artificial Sequence: Synthetic iRNA agent targeting human EGLN1 oligonucleotide
auugucaauaacgaaaccu

SEQ ID NO: 1126 - RNA, 19 nt, Artificial Sequence
  Description of Artificial Sequence: Synthetic iRNA agent targeting human EGLN1 oligonucleotide
agguuucguuauugacaau

SEQ ID NO: 1127 - RNA, 19 nt, Artificial Sequence
  Description of Artificial Sequence: Synthetic iRNA agent targeting human EGLN1 oligonucleotide
uugucaauaacgaaaccua

SEQ ID NO: 1128 - RNA, 19 nt, Artificial Sequence
  Description of Artificial Sequence: Synthetic iRNA agent targeting human EGLN1 oligonucleotide
uagguuucguuauugacaa

SEQ ID NO: 1129 - RNA, 19 nt, Artificial Sequence
  Description of Artificial Sequence: Synthetic iRNA agent targeting human EGLN1 oligonucleotide
ugucaauaacgaaaccuaa

SEQ ID NO: 1130 - RNA, 19 nt, Artificial Sequence
  Description of Artificial Sequence: Synthetic iRNA agent targeting human EGLN1 oligonucleotide
uuagguuucguuauugaca

SEQ ID NO: 1131 - RNA, 19 nt, Artificial Sequence
  Description of Artificial Sequence: Synthetic iRNA agent targeting human EGLN1 oligonucleotide
aauaacgaaaccuaauugu

SEQ ID NO: 1132 - RNA, 19 nt, Artificial Sequence
  Description of Artificial Sequence: Synthetic iRNA agent targeting human EGLN1 oligonucleotide
acaauuagguuucguuauu

SEQ ID NO: 1133 - RNA, 19 nt, Artificial Sequence
  Description of Artificial Sequence: Synthetic iRNA agent targeting human EGLN1 oligonucleotide
auaacgaaaccuaauugua

SEQ ID NO: 1134 - RNA, 19 nt, Artificial Sequence
  Description of Artificial Sequence: Synthetic iRNA agent targeting human EGLN1 oligonucleotide
uacaauuagguuucguuau

SEQ ID NO: 1135 - RNA, 19 nt, Artificial Sequence
  Description of Artificial Sequence: Synthetic iRNA agent targeting human EGLN1 oligonucleotide
ccuaauuguaaaacaguca

SEQ ID NO: 1136 - RNA, 19 nt, Artificial Sequence
  Description of Artificial Sequence: Synthetic iRNA agent targeting human EGLN1 oligonucleotide
ugacuguuuuacaauuagg

SEQ ID NO: 1137 - RNA, 19 nt, Artificial Sequence
  Description of Artificial Sequence: Synthetic iRNA agent targeting human EGLN1 oligonucleotide
uguaaaacagucaccauuu

SEQ ID NO: 1138 - RNA, 19 nt, Artificial Sequence
  Description of Artificial Sequence: Synthetic iRNA agent targeting human EGLN1 oligonucleotide
aaauggugacuguuuuaca

SEQ ID NO: 1139 - RNA, 19 nt, Artificial Sequence
  Description of Artificial Sequence: Synthetic iRNA agent targeting human EGLN1 oligonucleotide
gucaccauuuacuaccaau

SEQ ID NO: 1140 - RNA, 19 nt, Artificial Sequence
  Description of Artificial Sequence: Synthetic iRNA agent targeting human EGLN1 oligonucleotide
auugguaguaaauggugac

SEQ ID NO: 1141 - RNA, 19 nt, Artificial Sequence
  Description of Artificial Sequence: Synthetic iRNA agent targeting human EGLN1 oligonucleotide
ucaccauuuacuaccaaua

SEQ ID NO: 1142 - RNA, 19 nt, Artificial Sequence
  Description of Artificial Sequence: Synthetic iRNA agent targeting human EGLN1 oligonucleotide
uauugguaguaaaugguga

SEQ ID NO: 1143 - RNA, 19 nt, Artificial Sequence
  Description of Artificial Sequence: Synthetic iRNA agent targeting human EGLN1 oligonucleotide
caccauuuacuaccaauaa

SEQ ID NO: 1144 - RNA, 19 nt, Artificial Sequence
  Description of Artificial Sequence: Synthetic iRNA agent targeting human EGLN1 oligonucleotide
uuauugguaguaaauggug

SEQ ID NO: 1145 - RNA, 19 nt, Artificial Sequence
  Description of Artificial Sequence: Synthetic iRNA agent targeting human EGLN1 oligonucleotide
ccauuuacuaccaauaacu

SEQ ID NO: 1146 - RNA, 19 nt, Artificial Sequence
  Description of Artificial Sequence: Synthetic iRNA agent targeting human EGLN1 oligonucleotide
aguuauugguaguaaaugg

SEQ ID NO: 1147 - RNA, 19 nt, Artificial Sequence
  Description of Artificial Sequence: Synthetic iRNA agent targeting human EGLN1 oligonucleotide
ccuaggcugggguuuaagu

SEQ ID NO: 1148 - RNA, 19 nt, Artificial Sequence
  Description of Artificial Sequence: Synthetic iRNA agent targeting human EGLN1 oligonucleotide
acuuaaaccccagccuagg

SEQ ID NO: 1149 - RNA, 19 nt, Artificial Sequence
  Description of Artificial Sequence: Synthetic iRNA agent targeting human EGLN1 oligonucleotide
gcugggguuuaaguuaaau

SEQ ID NO: 1150 - RNA, 19 nt, Artificial Sequence
  Description of Artificial Sequence: Synthetic iRNA agent targeting human EGLN1 oligonucleotide
auuuaacuuaaaccccagc

SEQ ID NO: 1151 - RNA, 19 nt, Artificial Sequence
  Description of Artificial Sequence: Synthetic iRNA agent targeting human EGLN1 oligonucleotide
cugggguuuaaguuaaauu

SEQ ID NO: 1152 - RNA, 19 nt, Artificial Sequence
  Description of Artificial Sequence: Synthetic iRNA agent targeting human EGLN1 oligonucleotide
aauuuaacuuaaaccccag

SEQ ID NO: 1153 - RNA, 19 nt, Artificial Sequence
  Description of Artificial Sequence: Synthetic iRNA agent targeting human EGLN1 oligonucleotide
aacuaaagugacuggcacu

SEQ ID NO: 1154 - RNA, 19 nt, Artificial Sequence
  Description of Artificial Sequence: Synthetic iRNA agent targeting human EGLN1 oligonucleotide
agugccagucacuuuaguu

SEQ ID NO: 1155 - RNA, 19 nt, Artificial Sequence
  Description of Artificial Sequence: Synthetic iRNA agent targeting human EGLN1 oligonucleotide
gcuucaaguuccuaagaua

SEQ ID NO: 1156 - RNA, 19 nt, Artificial Sequence
  Description of Artificial Sequence: Synthetic iRNA agent targeting human EGLN1 oligonucleotide
uaucuuaggaacuugaagc

SEQ ID NO: 1157 - RNA, 19 nt, Artificial Sequence
  Description of Artificial Sequence: Synthetic iRNA agent targeting human EGLN1 oligonucleotide
guuccuaagauaagggcuu

SEQ ID NO: 1158 - RNA, 19 nt, Artificial Sequence
  Description of Artificial Sequence: Synthetic iRNA agent targeting human EGLN1 oligonucleotide
aagcccuuaucuuaggaac

SEQ ID NO: 1159 - RNA, 19 nt, Artificial Sequence
  Description of Artificial Sequence: Synthetic iRNA agent targeting human EGLN1 oligonucleotide
ccuaagauaagggcuuucu

SEQ ID NO: 1160 - RNA, 19 nt, Artificial Sequence
  Description of Artificial Sequence: Synthetic iRNA agent targeting human EGLN1 oligonucleotide
agaaagcccuuaucuuagg

SEQ ID NO: 1161 - RNA, 19 nt, Artificial Sequence
  Description of Artificial Sequence: Synthetic iRNA agent targeting human EGLN1 oligonucleotide
cagguguauguauccucua

SEQ ID NO: 1162 - RNA, 19 nt, Artificial Sequence
  Description of Artificial Sequence: Synthetic iRNA agent targeting human EGLN1 oligonucleotide
uagaggauacauacaccug

SEQ ID NO: 1163 - RNA, 19 nt, Artificial Sequence
  Description of Artificial Sequence: Synthetic iRNA agent targeting human EGLN1 oligonucleotide
gguguauguauccucuaga

SEQ ID NO: 1164 - RNA, 19 nt, Artificial Sequence
  Description of Artificial Sequence: Synthetic iRNA agent targeting human EGLN1 oligonucleotide
ucuagaggauacauacacc

SEQ ID NO: 1165 - RNA, 19 nt, Artificial Sequence
  Description of Artificial Sequence: Synthetic iRNA agent targeting human EGLN1 oligonucleotide
uauguauccucuagaugua

SEQ ID NO: 1166 - RNA, 19 nt, Artificial Sequence
  Description of Artificial Sequence: Synthetic iRNA agent targeting human EGLN1 oligonucleotide
uacaucuagaggauacaua

SEQ ID NO: 1167 - RNA, 19 nt, Artificial Sequence
  Description of Artificial Sequence: Synthetic iRNA agent targeting human EGLN1 oligonucleotide
uccucuagauguagacaau

SEQ ID NO: 1168 - RNA, 19 nt, Artificial Sequence
  Description of Artificial Sequence: Synthetic iRNA agent targeting human EGLN1 oligonucleotide
auugucuacaucuagagga

SEQ ID NO: 1169 - RNA, 19 nt, Artificial Sequence
  Description of Artificial Sequence: Synthetic iRNA agent targeting human EGLN1 oligonucleotide
ccucuagauguagacaaua

SEQ ID NO: 1170 - RNA, 19 nt, Artificial Sequence
  Description of Artificial Sequence: Synthetic iRNA agent targeting human EGLN1 oligonucleotide
uauugucuacaucuagagg

SEQ ID NO: 1171 - RNA, 19 nt, Artificial Sequence
  Description of Artificial Sequence: Synthetic iRNA agent targeting human EGLN1 oligonucleotide
augucccauuucuaagucu

SEQ ID NO: 1172 - RNA, 19 nt, Artificial Sequence
  Description of Artificial Sequence: Synthetic iRNA agent targeting human EGLN1 oligonucleotide
agacuuagaaaugggacau

SEQ ID NO: 1173 - RNA, 19 nt, Artificial Sequence
  Description of Artificial Sequence: Synthetic iRNA agent targeting human EGLN1 oligonucleotide
ugucccauuucuaagucuu

SEQ ID NO: 1174 - RNA, 19 nt, Artificial Sequence
  Description of Artificial Sequence: Synthetic iRNA agent targeting human EGLN1 oligonucleotide
aagacuuagaaaugggaca

SEQ ID NO: 1175 - RNA, 19 nt, Artificial Sequence
  Description of Artificial Sequence: Synthetic iRNA agent targeting human EGLN1 oligonucleotide
ucuccuuaaauugauugua

SEQ ID NO: 1176 - RNA, 19 nt, Artificial Sequence
  Description of Artificial Sequence: Synthetic iRNA agent targeting human EGLN1 oligonucleotide
uacaaucaauuuaaggaga

SEQ ID NO: 1177 - RNA, 19 nt, Artificial Sequence
  Description of Artificial Sequence: Synthetic iRNA agent targeting human EGLN1 oligonucleotide
uaaauugauuguacuucca

SEQ ID NO: 1178 - RNA, 19 nt, Artificial Sequence
  Description of Artificial Sequence: Synthetic iRNA agent targeting human EGLN1 oligonucleotide
uggaaguacaaucaauuua

SEQ ID NO: 1179 - RNA, 19 nt, Artificial Sequence
  Description of Artificial Sequence: Synthetic iRNA agent targeting human EGLN1 oligonucleotide
aaauugauuguacuuccaa

SEQ ID NO: 1180 - RNA, 19 nt, Artificial Sequence
  Description of Artificial Sequence: Synthetic iRNA agent targeting human EGLN1 oligonucleotide
uuggaaguacaaucaauuu

SEQ ID NO: 1181 - RNA, 19 nt, Artificial Sequence
  Description of Artificial Sequence: Synthetic iRNA agent targeting human EGLN1 oligonucleotide
auacugugaucuaucugau

SEQ ID NO: 1182 - RNA, 19 nt, Artificial Sequence
  Description of Artificial Sequence: Synthetic iRNA agent targeting human EGLN1 oligonucleotide
aucagauagaucacaguau

SEQ ID NO: 1183 - RNA, 19 nt, Artificial Sequence
  Description of Artificial Sequence: Synthetic iRNA agent targeting human EGLN1 oligonucleotide
ugucucuguugaagagcau

SEQ ID NO: 1184 - RNA, 19 nt, Artificial Sequence
  Description of Artificial Sequence: Synthetic iRNA agent targeting human EGLN1 oligonucleotide
augcucuucaacagagaca

SEQ ID NO: 1185 - RNA, 19 nt, Artificial Sequence
  Description of Artificial Sequence: Synthetic iRNA agent targeting human EGLN1 oligonucleotide
cucuguugaagagcaucaa

SEQ ID NO: 1186 - RNA, 19 nt, Artificial Sequence
  Description of Artificial Sequence: Synthetic iRNA agent targeting human EGLN1 oligonucleotide
uugaugcucuucaacagag

SEQ ID NO: 1187 - RNA, 19 nt, Artificial Sequence
  Description of Artificial Sequence: Synthetic iRNA agent targeting human EGLN1 oligonucleotide
agcaucaaggggagauuau

SEQ ID NO: 1188 - RNA, 19 nt, Artificial Sequence
  Description of Artificial Sequence: Synthetic iRNA agent targeting human EGLN1 oligonucleotide
auaaucuccccuugaugcu

SEQ ID NO: 1189 - RNA, 19 nt, Artificial Sequence
  Description of Artificial Sequence: Synthetic iRNA agent targeting human EGLN1 oligonucleotide
aucaaggggagauuaugua

SEQ ID NO: 1190 - RNA, 19 nt, Artificial Sequence
  Description of Artificial Sequence: Synthetic iRNA agent targeting human EGLN1 oligonucleotide
uacauaaucuccccuugau

SEQ ID NO: 1191 - RNA, 19 nt, Artificial Sequence
  Description of Artificial Sequence: Synthetic iRNA agent targeting human EGLN1 oligonucleotide
caaggggagauuauguaca

SEQ ID NO: 1192 - RNA, 19 nt, Artificial Sequence
  Description of Artificial Sequence: Synthetic iRNA agent targeting human EGLN1 oligonucleotide
uguacauaaucuccccuug

SEQ ID NO: 1193 - RNA, 19 nt, Artificial Sequence
  Description of Artificial Sequence: Synthetic iRNA agent targeting human EGLN1 oligonucleotide
ugugguguuacugacggaa

SEQ ID NO: 1194 - RNA, 19 nt, Artificial Sequence
  Description of Artificial Sequence: Synthetic iRNA agent targeting human EGLN1 oligonucleotide
uuccgucaguaacaccaca

SEQ ID NO: 1195 - RNA, 19 nt, Artificial Sequence
  Description of Artificial Sequence: Synthetic iRNA agent targeting human EGLN1 oligonucleotide
gguguuacugacggaaugu

SEQ ID NO: 1196 - RNA, 19 nt, Artificial Sequence
  Description of Artificial Sequence: Synthetic iRNA agent targeting human EGLN1 oligonucleotide
acauuccgucaguaacacc

SEQ ID NO: 1197 - RNA, 19 nt, Artificial Sequence
  Description of Artificial Sequence: Synthetic iRNA agent targeting human EGLN1 oligonucleotide
guuacugacggaaugugca

SEQ ID NO: 1198 - RNA, 19 nt, Artificial Sequence
  Description of Artificial Sequence: Synthetic iRNA agent targeting human EGLN1 oligonucleotide
ugcacauuccgucaguaac

SEQ ID NO: 1199 - RNA, 19 nt, Artificial Sequence
  Description of Artificial Sequence: Synthetic iRNA agent targeting human EGLN1 oligonucleotide
gacggaaugugcaguaacu

SEQ ID NO: 1200 - RNA, 19 nt, Artificial Sequence
  Description of Artificial Sequence: Synthetic iRNA agent targeting human EGLN1 oligonucleotide
aguuacugcacauuccguc

SEQ ID NO: 1201 - RNA, 19 nt, Artificial Sequence
  Description of Artificial Sequence: Synthetic iRNA agent targeting human EGLN1 oligonucleotide
aacuccucagauaucuguu

SEQ ID NO: 1202 - RNA, 19 nt, Artificial Sequence
  Description of Artificial Sequence: Synthetic iRNA agent targeting human EGLN1 oligonucleotide
aacagauaucugaggaguu

SEQ ID NO: 1203 - RNA, 19 nt, Artificial Sequence
  Description of Artificial Sequence: Synthetic iRNA agent targeting human EGLN1 oligonucleotide
cuccucagauaucuguuaa

SEQ ID NO: 1204 - RNA, 19 nt, Artificial Sequence
  Description of Artificial Sequence: Synthetic iRNA agent targeting human EGLN1 oligonucleotide
uuaacagauaucugaggag

SEQ ID NO: 1205 - RNA, 19 nt, Artificial Sequence
  Description of Artificial Sequence: Synthetic iRNA agent targeting human EGLN1 oligonucleotide
gccuucuuaccuguacuga

SEQ ID NO: 1206 - RNA, 19 nt, Artificial Sequence
  Description of Artificial Sequence: Synthetic iRNA agent targeting human EGLN1 oligonucleotide
ucaguacagguaagaaggc

SEQ ID NO: 1207 - RNA, 19 nt, Artificial Sequence
  Description of Artificial Sequence: Synthetic iRNA agent targeting human EGLN1 oligonucleotide
cuguacugaaagaugcuua

SEQ ID NO: 1208 - RNA, 19 nt, Artificial Sequence
  Description of Artificial Sequence: Synthetic iRNA agent targeting human EGLN1 oligonucleotide
uaagcaucuuucaguacag

SEQ ID NO: 1209 - RNA, 19 nt, Artificial Sequence
  Description of Artificial Sequence: Synthetic iRNA agent targeting human EGLN1 oligonucleotide
uacugaaagaugcuuagcu

SEQ ID NO: 1210 - RNA, 19 nt, Artificial Sequence
  Description of Artificial Sequence: Synthetic iRNA agent targeting human EGLN1 oligonucleotide
agcuaagcaucuuucagua

SEQ ID NO: 1211 - RNA, 19 nt, Artificial Sequence
  Description of Artificial Sequence: Synthetic iRNA agent targeting human EGLN1 oligonucleotide
gaaagaugcuuagcuuaga

SEQ ID NO: 1212 - RNA, 19 nt, Artificial Sequence
  Description of Artificial Sequence: Synthetic iRNA agent targeting human EGLN1 oligonucleotide
ucuaagcuaagcaucuuuc

SEQ ID NO: 1213 - RNA, 19 nt, Artificial Sequence
  Description of Artificial Sequence: Synthetic iRNA agent targeting human EGLN1 oligonucleotide
aagaugcuuagcuuagaaa

SEQ ID NO: 1214 - RNA, 19 nt, Artificial Sequence
  Description of Artificial Sequence: Synthetic iRNA agent targeting human EGLN1 oligonucleotide
uuucuaagcuaagcaucuu

SEQ ID NO: 1215 - RNA, 19 nt, Artificial Sequence
  Description of Artificial Sequence: Synthetic iRNA agent targeting human EGLN1 oligonucleotide
ucauggguuuucuuauuua

SEQ ID NO: 1216 - RNA, 19 nt, Artificial Sequence
  Description of Artificial Sequence: Synthetic iRNA agent targeting human EGLN1 oligonucleotide
uaaauaagaaaacccauga

SEQ ID NO: 1217 - RNA, 19 nt, Artificial Sequence
  Description of Artificial Sequence: Synthetic iRNA agent targeting human EGLN1 oligonucleotide
aaggccucacauacauguu

SEQ ID NO: 1218 - RNA, 19 nt, Artificial Sequence
  Description of Artificial Sequence: Synthetic iRNA agent targeting human EGLN1 oligonucleotide
aacauguaugugaggccuu

SEQ ID NO: 1219 - RNA, 19 nt, Artificial Sequence
  Description of Artificial Sequence: Synthetic iRNA agent targeting human EGLN1 oligonucleotide
ggccucacauacauguuau

SEQ ID NO: 1220 - RNA, 19 nt, Artificial Sequence
  Description of Artificial Sequence: Synthetic iRNA agent targeting human EGLN1 oligonucleotide
auaacauguaugugaggcc

SEQ ID NO: 1221 - RNA, 19 nt, Artificial Sequence
  Description of Artificial Sequence: Synthetic iRNA agent targeting human EGLN1 oligonucleotide
gccucacauacauguuauu

SEQ ID NO: 1222 - RNA, 19 nt, Artificial Sequence
  Description of Artificial Sequence: Synthetic iRNA agent targeting human EGLN1 oligonucleotide
aauaacauguaugugaggc

SEQ ID NO: 1223 - RNA, 19 nt, Artificial Sequence
  Description of Artificial Sequence: Synthetic iRNA agent targeting human EGLN1 oligonucleotide
ugaauugggacggaugucu

SEQ ID NO: 1224 - RNA, 19 nt, Artificial Sequence
  Description of Artificial Sequence: Synthetic iRNA agent targeting human EGLN1 oligonucleotide
agacauccgucccaauuca

SEQ ID NO: 1225 - RNA, 19 nt, Artificial Sequence
  Description of Artificial Sequence: Synthetic iRNA agent targeting human EGLN1 oligonucleotide
gaauugggacggaugucuu

SEQ ID NO: 1226 - RNA, 19 nt, Artificial Sequence
  Description of Artificial Sequence: Synthetic iRNA agent targeting human EGLN1 oligonucleotide
aagacauccgucccaauuc

SEQ ID NO: 1227 - RNA, 19 nt, Artificial Sequence
  Description of Artificial Sequence: Synthetic iRNA agent targeting human EGLN1 oligonucleotide
uugggacggaugucuuaga

SEQ ID NO: 1228 - RNA, 19 nt, Artificial Sequence
  Description of Artificial Sequence: Synthetic iRNA agent targeting human EGLN1 oligonucleotide
ucuaagacauccgucccaa

SEQ ID NO: 1229 - RNA, 19 nt, Artificial Sequence
  Description of Artificial Sequence: Synthetic iRNA agent targeting human EGLN1 oligonucleotide
gggacggaugucuuagacu

SEQ ID NO: 1230 - RNA, 19 nt, Artificial Sequence
  Description of Artificial Sequence: Synthetic iRNA agent targeting human EGLN1 oligonucleotide
agucuaagacauccguccc

SEQ ID NO: 1231 - RNA, 19 nt, Artificial Sequence
  Description of Artificial Sequence: Synthetic iRNA agent targeting human EGLN1 oligonucleotide
cuuagacuucacuuuccua

SEQ ID NO: 1232 - RNA, 19 nt, Artificial Sequence
  Description of Artificial Sequence: Synthetic iRNA agent targeting human EGLN1 oligonucleotide
uaggaaagugaagucuaag

SEQ ID NO: 1233 - RNA, 19 nt, Artificial Sequence
  Description of Artificial Sequence: Synthetic iRNA agent targeting human EGLN1 oligonucleotide
gacuucacuuuccuaggcu

SEQ ID NO: 1234 - RNA, 19 nt, Artificial Sequence
  Description of Artificial Sequence: Synthetic iRNA agent targeting human EGLN1 oligonucleotide
agccuaggaaagugaaguc

SEQ ID NO: 1235 - RNA, 19 nt, Artificial Sequence
  Description of Artificial Sequence: Synthetic iRNA agent targeting human EGLN1 oligonucleotide
acuucacuuuccuaggcuu

SEQ ID NO: 1236 - RNA, 19 nt, Artificial Sequence
  Description of Artificial Sequence: Synthetic iRNA agent targeting human EGLN1 oligonucleotide
aagccuaggaaagugaagu

SEQ ID NO: 1237 - RNA, 19 nt, Artificial Sequence
  Description of Artificial Sequence: Synthetic iRNA agent targeting human EGLN1 oligonucleotide
cuucacuuuccuaggcuuu

SEQ ID NO: 1238 - RNA, 19 nt, Artificial Sequence
  Description of Artificial Sequence: Synthetic iRNA agent targeting human EGLN1 oligonucleotide
aaagccuaggaaagugaag

SEQ ID NO: 1239 - RNA, 19 nt, Artificial Sequence
  Description of Artificial Sequence: Synthetic iRNA agent targeting human EGLN1 oligonucleotide
uucacuuuccuaggcuuuu

SEQ ID NO: 1240 - RNA, 19 nt, Artificial Sequence
  Description of Artificial Sequence: Synthetic iRNA agent targeting human EGLN1 oligonucleotide
aaaagccuaggaaagugaa

SEQ ID NO: 1241 - RNA, 19 nt, Artificial Sequence
  Description of Artificial Sequence: Synthetic iRNA agent targeting human EGLN1 oligonucleotide
accuaaagggugguaucca

SEQ ID NO: 1242 - RNA, 19 nt, Artificial Sequence
  Description of Artificial Sequence: Synthetic iRNA agent targeting human EGLN1 oligonucleotide
uggauaccacccuuuaggu

SEQ ID NO: 1243 - RNA, 19 nt, Artificial Sequence
  Description of Artificial Sequence: Synthetic iRNA agent targeting human EGLN1 oligonucleotide
uaaagggugguauccauau

SEQ ID NO: 1244 - RNA, 19 nt, Artificial Sequence
  Description of Artificial Sequence: Synthetic iRNA agent targeting human EGLN1 oligonucleotide
auauggauaccacccuuua

SEQ ID NO: 1245 - RNA, 19 nt, Artificial Sequence
  Description of Artificial Sequence: Synthetic iRNA agent targeting human EGLN1 oligonucleotide
aaagggugguauccauauu

SEQ ID NO: 1246 - RNA, 19 nt, Artificial Sequence
  Description of Artificial Sequence: Synthetic iRNA agent targeting human EGLN1 oligonucleotide
aauauggauaccacccuuu

SEQ ID NO: 1247 - RNA, 19 nt, Artificial Sequence
  Description of Artificial Sequence: Synthetic iRNA agent targeting human EGLN1 oligonucleotide
ugguauccauauuuugcgu

SEQ ID NO: 1248 - RNA, 19 nt, Artificial Sequence
  Description of Artificial Sequence: Synthetic iRNA agent targeting human EGLN1 oligonucleotide
acgcaaaauauggauacca

SEQ ID NO: 1249 - RNA, 19 nt, Artificial Sequence
  Description of Artificial Sequence: Synthetic iRNA agent targeting human EGLN1 oligonucleotide
guauccauauuuugcguga

SEQ ID NO: 1250 - RNA, 19 nt, Artificial Sequence
  Description of Artificial Sequence: Synthetic iRNA agent targeting human EGLN1 oligonucleotide
ucacgcaaaauauggauac

SEQ ID NO: 1251 - RNA, 19 nt, Artificial Sequence
  Description of Artificial Sequence: Synthetic iRNA agent targeting human EGLN1 oligonucleotide
uauccauauuuugcgugaa

SEQ ID NO: 1252 - RNA, 19 nt, Artificial Sequence
  Description of Artificial Sequence: Synthetic iRNA agent targeting human EGLN1 oligonucleotide
uucacgcaaaauauggaua

SEQ ID NO: 1253 - RNA, 19 nt, Artificial Sequence
  Description of Artificial Sequence: Synthetic iRNA agent targeting human EGLN1 oligonucleotide
auccauauuuugcgugaau

SEQ ID NO: 1254 - RNA, 19 nt, Artificial Sequence
  Description of Artificial Sequence: Synthetic iRNA agent targeting human EGLN1 oligonucleotide
auucacgcaaaauauggau

SEQ ID NO: 1255 - RNA, 19 nt, Artificial Sequence
  Description of Artificial Sequence: Synthetic iRNA agent targeting human EGLN1 oligonucleotide
ccauauuuugcgugaauua

SEQ ID NO: 1256 - RNA, 19 nt, Artificial Sequence
  Description of Artificial Sequence: Synthetic iRNA agent targeting human EGLN1 oligonucleotide
uaauucacgcaaaauaugg

SEQ ID NO: 1257 - RNA, 19 nt, Artificial Sequence
  Description of Artificial Sequence: Synthetic iRNA agent targeting human EGLN1 oligonucleotide
uugcgugaauuaugggugu

SEQ ID NO: 1258 - RNA, 19 nt, Artificial Sequence
  Description of Artificial Sequence: Synthetic iRNA agent targeting human EGLN1 oligonucleotide
acacccauaauucacgcaa

SEQ ID NO: 1259 - RNA, 19 nt, Artificial Sequence
  Description of Artificial Sequence: Synthetic iRNA agent targeting human EGLN1 oligonucleotide
aauuauggguguaagaccu

SEQ ID NO: 1260 - RNA, 19 nt, Artificial Sequence
  Description of Artificial Sequence: Synthetic iRNA agent targeting human EGLN1 oligonucleotide
aggucuuacacccauaauu

SEQ ID NO: 1261 - RNA, 19 nt, Artificial Sequence
  Description of Artificial Sequence: Synthetic iRNA agent targeting human EGLN1 oligonucleotide
auuauggguguaagaccuu

SEQ ID NO: 1262 - RNA, 19 nt, Artificial Sequence
  Description of Artificial Sequence: Synthetic iRNA agent targeting human EGLN1 oligonucleotide
aaggucuuacacccauaau

SEQ ID NO: 1263 - RNA, 19 nt, Artificial Sequence
  Description of Artificial Sequence: Synthetic iRNA agent targeting human EGLN1 oligonucleotide
gaccuugcccacuuagguu

SEQ ID NO: 1264 - RNA, 19 nt, Artificial Sequence
  Description of Artificial Sequence: Synthetic iRNA agent targeting human EGLN1 oligonucleotide
aaccuaagugggcaagguc

SEQ ID NO: 1265 - RNA, 19 nt, Artificial Sequence
  Description of Artificial Sequence: Synthetic iRNA agent targeting human EGLN1 oligonucleotide
acuuagguuuucuaucucu

SEQ ID NO: 1266 - RNA, 19 nt, Artificial Sequence
  Description of Artificial Sequence: Synthetic iRNA agent targeting human EGLN1 oligonucleotide
agagauagaaaaccuaagu

SEQ ID NO: 1267 - RNA, 19 nt, Artificial Sequence
  Description of Artificial Sequence: Synthetic iRNA agent targeting human EGLN1 oligonucleotide
uuagguuuucuaucucugu

SEQ ID NO: 1268 - RNA, 19 nt, Artificial Sequence
  Description of Artificial Sequence: Synthetic iRNA agent targeting human EGLN1 oligonucleotide
acagagauagaaaaccuaa

SEQ ID NO: 1269 - RNA, 19 nt, Artificial Sequence
  Description of Artificial Sequence: Synthetic iRNA agent targeting human EGLN1 oligonucleotide
uucuaucucuguccuugau

SEQ ID NO: 1270 - RNA, 19 nt, Artificial Sequence
  Description of Artificial Sequence: Synthetic iRNA agent targeting human EGLN1 oligonucleotide
aucaaggacagagauagaa

SEQ ID NO: 1271 - RNA, 19 nt, Artificial Sequence
  Description of Artificial Sequence: Synthetic iRNA agent targeting human EGLN1 oligonucleotide
cuaucucuguccuugaucu

SEQ ID NO: 1272 - RNA, 19 nt, Artificial Sequence
  Description of Artificial Sequence: Synthetic iRNA agent targeting human EGLN1 oligonucleotide
agaucaaggacagagauag

SEQ ID NO: 1273 - RNA, 19 nt, Artificial Sequence
  Description of Artificial Sequence: Synthetic iRNA agent targeting human EGLN1 oligonucleotide
gccaaaaugugaguauaca

SEQ ID NO: 1274 - RNA, 19 nt, Artificial Sequence
  Description of Artificial Sequence: Synthetic iRNA agent targeting human EGLN1 oligonucleotide
uguauacucacauuuuggc

SEQ ID NO: 1275 - RNA, 19 nt, Artificial Sequence
  Description of Artificial Sequence: Synthetic iRNA agent targeting human EGLN1 oligonucleotide
caaaaugugaguauacaga

SEQ ID NO: 1276 - RNA, 19 nt, Artificial Sequence
  Description of Artificial Sequence: Synthetic iRNA agent targeting human EGLN1 oligonucleotide
ucuguauacucacauuuug

SEQ ID NO: 1277 - RNA, 19 nt, Artificial Sequence
  Description of Artificial Sequence: Synthetic iRNA agent targeting human EGLN1 oligonucleotide
agcaucuguauaguuugua

SEQ ID NO: 1278 - RNA, 19 nt, Artificial Sequence
  Description of Artificial Sequence: Synthetic iRNA agent targeting human EGLN1 oligonucleotide
uacaaacuauacagaugcu

SEQ ID NO: 1279 - RNA, 19 nt, Artificial Sequence
  Description of Artificial Sequence: Synthetic iRNA agent targeting human EGLN1 oligonucleotide
guauucaauuugagaccuu

SEQ ID NO: 1280 - RNA, 19 nt, Artificial Sequence
  Description of Artificial Sequence: Synthetic iRNA agent targeting human EGLN1 oligonucleotide
aaggucucaaauugaauac

SEQ ID NO: 1281 - RNA, 19 nt, Artificial Sequence
  Description of Artificial Sequence: Synthetic iRNA agent targeting human EGLN1 oligonucleotide
accuuuucuaugggaagcu

SEQ ID NO: 1282 - RNA, 19 nt, Artificial Sequence
  Description of Artificial Sequence: Synthetic iRNA agent targeting human EGLN1 oligonucleotide
agcuucccauagaaaaggu

SEQ ID NO: 1283 - RNA, 19 nt, Artificial Sequence
  Description of Artificial Sequence: Synthetic iRNA agent targeting human EGLN1 oligonucleotide
cuuuucuaugggaagcuca

SEQ ID NO: 1284 - RNA, 19 nt, Artificial Sequence
  Description of Artificial Sequence: Synthetic iRNA agent targeting human EGLN1 oligonucleotide
ugagcuucccauagaaaag

SEQ ID NO: 1285 - RNA, 19 nt, Artificial Sequence
  Description of Artificial Sequence: Synthetic iRNA agent targeting human EGLN1 oligonucleotide
uugccauugcuauucaugu

SEQ ID NO: 1286 - RNA, 19 nt, Artificial Sequence
  Description of Artificial Sequence: Synthetic iRNA agent targeting human EGLN1 oligonucleotide
acaugaauagcaauggcaa

SEQ ID NO: 1287 - RNA, 19 nt, Artificial Sequence
  Description of Artificial Sequence: Synthetic iRNA agent targeting human EGLN1 oligonucleotide
gggauugaauguucaguau

SEQ ID NO: 1288 - RNA, 19 nt, Artificial Sequence
  Description of Artificial Sequence: Synthetic iRNA agent targeting human EGLN1 oligonucleotide
auacugaacauucaauccc

SEQ ID NO: 1289 - RNA, 19 nt, Artificial Sequence
  Description of Artificial Sequence: Synthetic iRNA agent targeting human EGLN1 oligonucleotide
auagugaucucacuuagga

SEQ ID NO: 1290 - RNA, 19 nt, Artificial Sequence
  Description of Artificial Sequence: Synthetic iRNA agent targeting human EGLN1 oligonucleotide
uccuaagugagaucacuau

SEQ ID NO: 1291 - RNA, 19 nt, Artificial Sequence
  Description of Artificial Sequence: Synthetic iRNA agent targeting human EGLN1 oligonucleotide
ggagaaagugauaguuuau

SEQ ID NO: 1292 - RNA, 19 nt, Artificial Sequence
  Description of Artificial Sequence: Synthetic iRNA agent targeting human EGLN1 oligonucleotide
auaaacuaucacuuucucc

SEQ ID NO: 1293 - RNA, 19 nt, Artificial Sequence
  Description of Artificial Sequence: Synthetic iRNA agent targeting human EGLN1 oligonucleotide
uuuuccucgcccauauuca

SEQ ID NO: 1294 - RNA, 19 nt, Artificial Sequence
  Description of Artificial Sequence: Synthetic iRNA agent targeting human EGLN1 oligonucleotide
ugaauaugggcgaggaaaa

SEQ ID NO: 1295 - RNA, 19 nt, Artificial Sequence
  Description of Artificial Sequence: Synthetic iRNA agent targeting human EGLN1 oligonucleotide
uccucgcccauauucaguu

SEQ ID NO: 1296 - RNA, 19 nt, Artificial Sequence
  Description of Artificial Sequence: Synthetic iRNA agent targeting human EGLN1 oligonucleotide
aacugaauaugggcgagga

SEQ ID NO: 1297 - RNA, 19 nt, Artificial Sequence
  Description of Artificial Sequence: Synthetic iRNA agent targeting human EGLN1 oligonucleotide
ccucgcccauauucaguuu

SEQ ID NO: 1298 - RNA, 19 nt, Artificial Sequence
  Description of Artificial Sequence: Synthetic iRNA agent targeting human EGLN1 oligonucleotide
aaacugaauaugggcgagg

SEQ ID NO: 1299 - RNA, 19 nt, Artificial Sequence
  Description of Artificial Sequence: Synthetic iRNA agent targeting human EGLN1 oligonucleotide
cucgcccauauucaguuuu

SEQ ID NO: 1300 - RNA, 19 nt, Artificial Sequence
  Description of Artificial Sequence: Synthetic iRNA agent targeting human EGLN1 oligonucleotide
aaaacugaauaugggcgag

SEQ ID NO: 1301 - RNA, 19 nt, Artificial Sequence
  Description of Artificial Sequence: Synthetic iRNA agent targeting human EGLN1 oligonucleotide
cgcccauauucaguuuugu

SEQ ID NO: 1302 - RNA, 19 nt, Artificial Sequence
  Description of Artificial Sequence: Synthetic iRNA agent targeting human EGLN1 oligonucleotide
acaaaacugaauaugggcg

SEQ ID NO: 1303 - RNA, 19 nt, Artificial Sequence
  Description of Artificial Sequence: Synthetic iRNA agent targeting human EGLN1 oligonucleotide
agaugauaacaucacaucu

SEQ ID NO: 1304 - RNA, 19 nt, Artificial Sequence
  Description of Artificial Sequence: Synthetic iRNA agent targeting human EGLN1 oligonucleotide
agaugugauguuaucaucu

SEQ ID NO: 1305 - RNA, 19 nt, Artificial Sequence
  Description of Artificial Sequence: Synthetic iRNA agent targeting human EGLN1 oligonucleotide
ucacaucucuacaguaagu

SEQ ID NO: 1306 - RNA, 19 nt, Artificial Sequence
  Description of Artificial Sequence: Synthetic iRNA agent targeting human EGLN1 oligonucleotide
acuuacuguagagauguga

SEQ ID NO: 1307 - RNA, 19 nt, Artificial Sequence
  Description of Artificial Sequence: Synthetic iRNA agent targeting human EGLN1 oligonucleotide
ccaacccaggagcgcaagu

SEQ ID NO: 1308 - RNA, 19 nt, Artificial Sequence
  Description of Artificial Sequence: Synthetic iRNA agent targeting human EGLN1 oligonucleotide
acuugcgcuccuggguugg

SEQ ID NO: 1309 - RNA, 19 nt, Artificial Sequence
  Description of Artificial Sequence: Synthetic iRNA agent targeting human EGLN1 oligonucleotide
caacccaggagcgcaaguu

SEQ ID NO: 1310 - RNA, 19 nt, Artificial Sequence
  Description of Artificial Sequence: Synthetic iRNA agent targeting human EGLN1 oligonucleotide
aacuugcgcuccuggguug

SEQ ID NO: 1311 - RNA, 19 nt, Artificial Sequence
  Description of Artificial Sequence: Synthetic iRNA agent targeting human EGLN1 oligonucleotide
ccaucuggucuauaguaca

SEQ ID NO: 1312 - RNA, 19 nt, Artificial Sequence
  Description of Artificial Sequence: Synthetic iRNA agent targeting human EGLN1 oligonucleotide
uguacuauagaccagaugg

SEQ ID NO: 1313 - RNA, 19 nt, Artificial Sequence
  Description of Artificial Sequence: Synthetic iRNA agent targeting human EGLN1 oligonucleotide
auaguacagugcgcggcgu

SEQ ID NO: 1314 - RNA, 19 nt, Artificial Sequence
  Description of Artificial Sequence: Synthetic iRNA agent targeting human EGLN1 oligonucleotide
acgccgcgcacuguacuau

SEQ ID NO: 1315 - RNA, 19 nt, Artificial Sequence
  Description of Artificial Sequence: Synthetic iRNA agent targeting human EGLN1 oligonucleotide
uaguacagugcgcggcguu

SEQ ID NO: 1316 - RNA, 19 nt, Artificial Sequence
  Description of Artificial Sequence: Synthetic iRNA agent targeting human EGLN1 oligonucleotide
aacgccgcgcacuguacua

SEQ ID NO: 1317 - RNA, 19 nt, Artificial Sequence
  Description of Artificial Sequence: Synthetic iRNA agent targeting human EGLN1 oligonucleotide
aguacagugcgcggcguua

SEQ ID NO: 1318 - RNA, 19 nt, Artificial Sequence
  Description of Artificial Sequence: Synthetic iRNA agent targeting human EGLN1 oligonucleotide
uaacgccgcgcacuguacu

SEQ ID NO: 1319 - RNA, 19 nt, Artificial Sequence
  Description of Artificial Sequence: Synthetic iRNA agent targeting human EGLN1 oligonucleotide
agugcgcggcguuaggcca

SEQ ID NO: 1320 - RNA, 19 nt, Artificial Sequence
  Description of Artificial Sequence: Synthetic iRNA agent targeting human EGLN1 oligonucleotide
uggccuaacgccgcgcacu

SEQ ID NO: 1321 - RNA, 19 nt, Artificial Sequence
  Description of Artificial Sequence: Synthetic iRNA agent targeting human EGLN1 oligonucleotide
ugcgcggcguuaggccaca

SEQ ID NO: 1322 - RNA, 19 nt, Artificial Sequence
  Description of Artificial Sequence: Synthetic iRNA agent targeting human EGLN1 oligonucleotide
uguggccuaacgccgcgca

SEQ ID NO: 1323 - RNA, 19 nt, Artificial Sequence
  Description of Artificial Sequence: Synthetic iRNA agent targeting human EGLN1 oligonucleotide
gcgcggcguuaggccacaa

SEQ ID NO: 1324 - RNA, 19 nt, Artificial Sequence
  Description of Artificial Sequence: Synthetic iRNA agent targeting human EGLN1 oligonucleotide
uuguggccuaacgccgcgc

SEQ ID NO: 1325 - RNA, 19 nt, Artificial Sequence
  Description of Artificial Sequence: Synthetic iRNA agent targeting human EGLN1 oligonucleotide
gcguuaggccacaacucaa

SEQ ID NO: 1326 - RNA, 19 nt, Artificial Sequence
  Description of Artificial Sequence: Synthetic iRNA agent targeting human EGLN1 oligonucleotide
uugaguuguggccuaacgc

SEQ ID NO: 1327 - RNA, 19 nt, Artificial Sequence
  Description of Artificial Sequence: Synthetic iRNA agent targeting human EGLN1 oligonucleotide
cguuaggccacaacucaaa

SEQ ID NO: 1328 - RNA, 19 nt, Artificial Sequence
  Description of Artificial Sequence: Synthetic iRNA agent targeting human EGLN1 oligonucleotide
uuugaguuguggccuaacg

SEQ ID NO: 1329 - RNA, 19 nt, Artificial Sequence
  Description of Artificial Sequence: Synthetic iRNA agent targeting human EGLN1 oligonucleotide
uuuaggguuaguagaaauu

SEQ ID NO: 1330 - RNA, 19 nt, Artificial Sequence
  Description of Artificial Sequence: Synthetic iRNA agent targeting human EGLN1 oligonucleotide
aauuucuacuaacccuaaa

SEQ ID NO: 1331 - RNA, 19 nt, Artificial Sequence
  Description of Artificial Sequence: Synthetic iRNA agent targeting human EGLN1 oligonucleotide
uuuauguugaugggagguu

SEQ ID NO: 1332 - RNA, 19 nt, Artificial Sequence
  Description of Artificial Sequence: Synthetic iRNA agent targeting human EGLN1 oligonucleotide
aaccucccaucaacauaaa

SEQ ID NO: 1333 - RNA, 19 nt, Artificial Sequence
  Description of Artificial Sequence: Synthetic iRNA agent targeting human EGLN1 oligonucleotide
gggagguuuguuugauugu

SEQ ID NO: 1334 - RNA, 19 nt, Artificial Sequence
  Description of Artificial Sequence: Synthetic iRNA agent targeting human EGLN1 oligonucleotide
acaaucaaacaaaccuccc

SEQ ID NO: 1335 - RNA, 19 nt, Artificial Sequence
  Description of Artificial Sequence: Synthetic iRNA agent targeting human EGLN1 oligonucleotide
acagccuuuuaauuuggga

SEQ ID NO: 1336 - RNA, 19 nt, Artificial Sequence
  Description of Artificial Sequence: Synthetic iRNA agent targeting human EGLN1 oligonucleotide
ucccaaauuaaaaggcugu

SEQ ID NO: 1337 - RNA, 19 nt, Artificial Sequence
  Description of Artificial Sequence: Synthetic iRNA agent targeting human EGLN1 oligonucleotide
agccccuguugucauucaa

SEQ ID NO: 1338 - RNA, 19 nt, Artificial Sequence
  Description of Artificial Sequence: Synthetic iRNA agent targeting human EGLN1 oligonucleotide
uugaaugacaacaggggcu

SEQ ID NO: 1339 - RNA, 19 nt, Artificial Sequence
  Description of Artificial Sequence: Synthetic iRNA agent targeting human EGLN1 oligonucleotide
gucauucaaauguguaccu

SEQ ID NO: 1340 - RNA, 19 nt, Artificial Sequence
  Description of Artificial Sequence: Synthetic iRNA agent targeting human EGLN1 oligonucleotide
agguacacauuugaaugac

SEQ ID NO: 1341 - RNA, 19 nt, Artificial Sequence
  Description of Artificial Sequence: Synthetic iRNA agent targeting human EGLN1 oligonucleotide
auucaaauguguaccucua

SEQ ID NO: 1342 - RNA, 19 nt, Artificial Sequence
  Description of Artificial Sequence: Synthetic iRNA agent targeting human EGLN1 oligonucleotide
uagagguacacauuugaau

SEQ ID NO: 1343 - RNA, 19 nt, Artificial Sequence
  Description of Artificial Sequence: Synthetic iRNA agent targeting human EGLN1 oligonucleotide
cuaucuguggguugugcuu

SEQ ID NO: 1344 - RNA, 19 nt, Artificial Sequence
  Description of Artificial Sequence: Synthetic iRNA agent targeting human EGLN1 oligonucleotide
aagcacaacccacagauag

SEQ ID NO: 1345 - RNA, 19 nt, Artificial Sequence
  Description of Artificial Sequence: Synthetic iRNA agent targeting human EGLN1 oligonucleotide
gugcuugccagacaggucu

SEQ ID NO: 1346 - RNA, 19 nt, Artificial Sequence
  Description of Artificial Sequence: Synthetic iRNA agent targeting human EGLN1 oligonucleotide
agaccugucuggcaagcac

SEQ ID NO: 1347 - RNA, 19 nt, Artificial Sequence
  Description of Artificial Sequence: Synthetic iRNA agent targeting human EGLN1 oligonucleotide
uauacucucuuaggaauca

SEQ ID NO: 1348 - RNA, 19 nt, Artificial Sequence
  Description of Artificial Sequence: Synthetic iRNA agent targeting human EGLN1 oligonucleotide
ugauuccuaagagaguaua

SEQ ID NO: 1349 - RNA, 19 nt, Artificial Sequence
  Description of Artificial Sequence: Synthetic iRNA agent targeting human EGLN1 oligonucleotide
caagaaaucaggauggcca

SEQ ID NO: 1350 - RNA, 19 nt, Artificial Sequence
  Description of Artificial Sequence: Synthetic iRNA agent targeting human EGLN1 oligonucleotide
uggccauccugauuucuug

SEQ ID NO: 1351 - RNA, 19 nt, Artificial Sequence
  Description of Artificial Sequence: Synthetic iRNA agent targeting human EGLN1 oligonucleotide
cauguuagugggacuauua

SEQ ID NO: 1352 - RNA, 19 nt, Artificial Sequence
  Description of Artificial Sequence: Synthetic iRNA agent targeting human EGLN1 oligonucleotide
uaauagucccacuaacaug

SEQ ID NO: 1353 - RNA, 19 nt, Artificial Sequence
  Description of Artificial Sequence: Synthetic iRNA agent targeting human EGLN1 oligonucleotide
acuauuaacuugucaccaa

SEQ ID NO: 1354 - RNA, 19 nt, Artificial Sequence
  Description of Artificial Sequence: Synthetic iRNA agent targeting human EGLN1 oligonucleotide
uuggugacaaguuaauagu

SEQ ID NO: 1355 - RNA, 19 nt, Artificial Sequence
  Description of Artificial Sequence: Synthetic iRNA agent targeting human EGLN1 oligonucleotide
auauguguuuaauccuggu

SEQ ID NO: 1356 - RNA, 19 nt, Artificial Sequence
  Description of Artificial Sequence: Synthetic iRNA agent targeting human EGLN1 oligonucleotide
accaggauuaaacacauau

SEQ ID NO: 1357 - RNA, 19 nt, Artificial Sequence
  Description of Artificial Sequence: Synthetic iRNA agent targeting human EGLN1 oligonucleotide
guuuaauccugguuaaaga

SEQ ID NO: 1358 - RNA, 19 nt, Artificial Sequence
  Description of Artificial Sequence: Synthetic iRNA agent targeting human EGLN1 oligonucleotide
ucuuuaaccaggauuaaac

SEQ ID NO: 1359 - RNA, 19 nt, Artificial Sequence
  Description of Artificial Sequence: Synthetic iRNA agent targeting human EGLN1 oligonucleotide
uuuaauccugguuaaagau

SEQ ID NO: 1360 - RNA, 19 nt, Artificial Sequence
  Description of Artificial Sequence: Synthetic iRNA agent targeting human EGLN1 oligonucleotide
aucuuuaaccaggauuaaa

SEQ ID NO: 1361 - RNA, 19 nt, Artificial Sequence
  Description of Artificial Sequence: Synthetic iRNA agent targeting human EGLN1 oligonucleotide
uucaacacauuaaccagcu

SEQ ID NO: 1362 - RNA, 19 nt, Artificial Sequence
  Description of Artificial Sequence: Synthetic iRNA agent targeting human EGLN1 oligonucleotide
agcugguuaauguguugaa

SEQ ID NO: 1363 - RNA, 19 nt, Artificial Sequence
  Description of Artificial Sequence: Synthetic iRNA agent targeting human EGLN1 oligonucleotide
ccuuuaucaagaguaggca

SEQ ID NO: 1364 - RNA, 19 nt, Artificial Sequence
  Description of Artificial Sequence: Synthetic iRNA agent targeting human EGLN1 oligonucleotide
ugccuacucuugauaaagg

SEQ ID NO: 1365 - RNA, 19 nt, Artificial Sequence
  Description of Artificial Sequence: Synthetic iRNA agent targeting human EGLN1 oligonucleotide
cuuuaucaagaguaggcaa

SEQ ID NO: 1366 - RNA, 19 nt, Artificial Sequence
  Description of Artificial Sequence: Synthetic iRNA agent targeting human EGLN1 oligonucleotide
uugccuacucuugauaaag

SEQ ID NO: 1367 - RNA, 19 nt, Artificial Sequence
  Description of Artificial Sequence: Synthetic iRNA agent targeting human EGLN1 oligonucleotide
uucauauacagauagacua

SEQ ID NO: 1368 - RNA, 19 nt, Artificial Sequence
  Description of Artificial Sequence: Synthetic iRNA agent targeting human EGLN1 oligonucleotide
uagucuaucuguauaugaa

SEQ ID NO: 1369 - RNA, 19 nt, Artificial Sequence
  Description of Artificial Sequence: Synthetic iRNA agent targeting human EGLN1 oligonucleotide
auagacuauaaagucaugu

SEQ ID NO: 1370 - RNA, 19 nt, Artificial Sequence
  Description of Artificial Sequence: Synthetic iRNA agent targeting human EGLN1 oligonucleotide
acaugacuuuauagucuau

SEQ ID NO: 1371 - RNA, 19 nt, Artificial Sequence
  Description of Artificial Sequence: Synthetic iRNA agent targeting human EGLN1 oligonucleotide
uagacuauaaagucaugua

SEQ ID NO: 1372 - RNA, 19 nt, Artificial Sequence
  Description of Artificial Sequence: Synthetic iRNA agent targeting human EGLN1 oligonucleotide
uacaugacuuuauagucua

SEQ ID NO: 1373 - RNA, 19 nt, Artificial Sequence
  Description of Artificial Sequence: Synthetic iRNA agent targeting human EGLN1 oligonucleotide
caaguugcuuguaaagcua

SEQ ID NO: 1374 - RNA, 19 nt, Artificial Sequence
  Description of Artificial Sequence: Synthetic iRNA agent targeting human EGLN1 oligonucleotide
uagcuuuacaagcaacuug

SEQ ID NO: 1375 - RNA, 19 nt, Artificial Sequence
  Description of Artificial Sequence: Synthetic iRNA agent targeting human EGLN1 oligonucleotide
aaguugcuuguaaagcuaa

SEQ ID NO: 1376 - RNA, 19 nt, Artificial Sequence
  Description of Artificial Sequence: Synthetic iRNA agent targeting human EGLN1 oligonucleotide
uuagcuuuacaagcaacuu

SEQ ID NO: 1377 - RNA, 19 nt, Artificial Sequence
  Description of Artificial Sequence: Synthetic iRNA agent targeting human EGLN1 oligonucleotide
ugcuuguaaagcuaaucua

SEQ ID NO: 1378 - RNA, 19 nt, Artificial Sequence
  Description of Artificial Sequence: Synthetic iRNA agent targeting human EGLN1 oligonucleotide
uagauuagcuuuacaagca

SEQ ID NO: 1379 - RNA, 19 nt, Artificial Sequence
  Description of Artificial Sequence: Synthetic iRNA agent targeting human EGLN1 oligonucleotide
gcuuguaaagcuaaucuaa

SEQ ID NO: 1380 - RNA, 19 nt, Artificial Sequence
  Description of Artificial Sequence: Synthetic iRNA agent targeting human EGLN1 oligonucleotide
uuagauuagcuuuacaagc

SEQ ID NO: 1381 - RNA, 19 nt, Artificial Sequence
  Description of Artificial Sequence: Synthetic iRNA agent targeting human EGLN2 oligonucleotide
ccacccugaagggucccuu

SEQ ID NO: 1382 - RNA, 19 nt, Artificial Sequence
  Description of Artificial Sequence: Synthetic iRNA agent targeting human EGLN2 oligonucleotide
aagggacccuucagggugg

SEQ ID NO: 1383 - RNA, 19 nt, Artificial Sequence
  Description of Artificial Sequence: Synthetic iRNA agent targeting human EGLN2 oligonucleotide
gucccuucccaagcccuua

SEQ ID NO: 1384 - RNA, 19 nt, Artificial Sequence
  Description of Artificial Sequence: Synthetic iRNA agent targeting human EGLN2 oligonucleotide
uaagggcuugggaagggac

SEQ ID NO: 1385 - RNA, 19 nt, Artificial Sequence
  Description of Artificial Sequence: Synthetic iRNA agent targeting human EGLN2 oligonucleotide
cuucccaagcccuuaggga

SEQ ID NO: 1386 - RNA, 19 nt, Artificial Sequence
  Description of Artificial Sequence: Synthetic iRNA agent targeting human EGLN2 oligonucleotide
ucccuaagggcuugggaag

SEQ ID NO: 1387 - RNA, 19 nt, Artificial Sequence
  Description of Artificial Sequence: Synthetic iRNA agent targeting human EGLN2 oligonucleotide
caagcccuuagggaccgca

SEQ ID NO: 1388 - RNA, 19 nt, Artificial Sequence
  Description of Artificial Sequence: Synthetic iRNA agent targeting human EGLN2 oligonucleotide
ugcggucccuaagggcuug

SEQ ID NO: 1389 - RNA, 19 nt, Artificial Sequence
  Description of Artificial Sequence: Synthetic iRNA agent targeting human EGLN2 oligonucleotide
uagggaccgcagaggacuu

SEQ ID NO: 1390 - RNA, 19 nt, Artificial Sequence
  Description of Artificial Sequence: Synthetic iRNA agent targeting human EGLN2 oligonucleotide
aaguccucugcggucccua

SEQ ID NO: 1391 - RNA, 19 nt, Artificial Sequence
  Description of Artificial Sequence: Synthetic iRNA agent targeting human EGLN2 oligonucleotide
accgcagaggacuugggga

SEQ ID NO: 1392 - RNA, 19 nt, Artificial Sequence
  Description of Artificial Sequence: Synthetic iRNA agent targeting human EGLN2 oligonucleotide
uccccaaguccucugcggu

SEQ ID NO: 1393 - RNA, 19 nt, Artificial Sequence
  Description of Artificial Sequence: Synthetic iRNA agent targeting human EGLN2 oligonucleotide
acuuggggaccagcaagca

SEQ ID NO: 1394 - RNA, 19 nt, Artificial Sequence
  Description of Artificial Sequence: Synthetic iRNA agent targeting human EGLN2 oligonucleotide
ugcuugcugguccccaagu

SEQ ID NO: 1395 - RNA, 19 nt, Artificial Sequence
  Description of Artificial Sequence: Synthetic iRNA agent targeting human EGLN2 oligonucleotide
cuuggggaccagcaagcaa

SEQ ID NO: 1396 - RNA, 19 nt, Artificial Sequence
  Description of Artificial Sequence: Synthetic iRNA agent targeting human EGLN2 oligonucleotide
uugcuugcugguccccaag

SEQ ID NO: 1397 - RNA, 19 nt, Artificial Sequence
  Description of Artificial Sequence: Synthetic iRNA agent targeting human EGLN2 oligonucleotide
gaccagcaagcaaccccca

SEQ ID NO: 1398 - RNA, 19 nt, Artificial Sequence
  Description of Artificial Sequence: Synthetic iRNA agent targeting human EGLN2 oligonucleotide
uggggguugcuugcugguc

SEQ ID NO: 1399 - RNA, 19 nt, Artificial Sequence
  Description of Artificial Sequence: Synthetic iRNA agent targeting human EGLN2 oligonucleotide
caacccccagggcacgaga

SEQ ID NO: 1400 - RNA, 19 nt, Artificial Sequence
  Description of Artificial Sequence: Synthetic iRNA agent targeting human EGLN2 oligonucleotide
ucucgugcccuggggguug

SEQ ID NO: 1401 - RNA, 19 nt, Artificial Sequence
  Description of Artificial Sequence: Synthetic iRNA agent targeting human EGLN2 oligonucleotide
aacccccagggcacgagaa

SEQ ID NO: 1402 - RNA, 19 nt, Artificial Sequence
  Description of Artificial Sequence: Synthetic iRNA agent targeting human EGLN2 oligonucleotide
uucucgugcccuggggguu

SEQ ID NO: 1403 - RNA, 19 nt, Artificial Sequence
  Description of Artificial Sequence: Synthetic iRNA agent targeting human EGLN2 oligonucleotide
cccccagggcacgagaaga

SEQ ID NO: 1404 - RNA, 19 nt, Artificial Sequence
  Description of Artificial Sequence: Synthetic iRNA agent targeting human EGLN2 oligonucleotide
ucuucucgugcccuggggg

SEQ ID NO: 1405 - RNA, 19 nt, Artificial Sequence
  Description of Artificial Sequence: Synthetic iRNA agent targeting human EGLN2 oligonucleotide
cacgagaagagcucuugcu

SEQ ID NO: 1406 - RNA, 19 nt, Artificial Sequence
  Description of Artificial Sequence: Synthetic iRNA agent targeting human EGLN2 oligonucleotide
agcaagagcucuucucgug

SEQ ID NO: 1407 - RNA, 19 nt, Artificial Sequence
  Description of Artificial Sequence: Synthetic iRNA agent targeting human EGLN2 oligonucleotide
cgagaagagcucuugcugu

SEQ ID NO: 1408 - RNA, 19 nt, Artificial Sequence
  Description of Artificial Sequence: Synthetic iRNA agent targeting human EGLN2 oligonucleotide
acagcaagagcucuucucg

SEQ ID NO: 1409 - RNA, 19 nt, Artificial Sequence
  Description of Artificial Sequence: Synthetic iRNA agent targeting human EGLN2 oligonucleotide
agaagagcucuugcugucu

SEQ ID NO: 1410 - RNA, 19 nt, Artificial Sequence
  Description of Artificial Sequence: Synthetic iRNA agent targeting human EGLN2 oligonucleotide
agacagcaagagcucuucu

SEQ ID NO: 1411 - RNA, 19 nt, Artificial Sequence
  Description of Artificial Sequence: Synthetic iRNA agent targeting human EGLN2 oligonucleotide
gcccccagcugcaucaagu

SEQ ID NO: 1412 - RNA, 19 nt, Artificial Sequence
  Description of Artificial Sequence: Synthetic iRNA agent targeting human EGLN2 oligonucleotide
acuugaugcagcugggggc

SEQ ID NO: 1413 - RNA, 19 nt, Artificial Sequence
  Description of Artificial Sequence: Synthetic iRNA agent targeting human EGLN2 oligonucleotide
caccaugggcccgggcggu

SEQ ID NO: 1414 - RNA, 19 nt, Artificial Sequence
  Description of Artificial Sequence: Synthetic iRNA agent targeting human EGLN2 oligonucleotide
accgcccgggcccauggug

SEQ ID NO: 1415 - RNA, 19 nt, Artificial Sequence
  Description of Artificial Sequence: Synthetic iRNA agent targeting human EGLN2 oligonucleotide
cccgggcggugcccuccau

SEQ ID NO: 1416 - RNA, 19 nt, Artificial Sequence
  Description of Artificial Sequence: Synthetic iRNA agent targeting human EGLN2 oligonucleotide
auggagggcaccgcccggg

SEQ ID NO: 1417 - RNA, 19 nt, Artificial Sequence
  Description of Artificial Sequence: Synthetic iRNA agent targeting human EGLN2 oligonucleotide
cuccaugcccgggggauga

SEQ ID NO: 1418 - RNA, 19 nt, Artificial Sequence
  Description of Artificial Sequence: Synthetic iRNA agent targeting human EGLN2 oligonucleotide
ucaucccccgggcauggag

SEQ ID NO: 1419 - RNA, 19 nt, Artificial Sequence
  Description of Artificial Sequence: Synthetic iRNA agent targeting human EGLN2 oligonucleotide
caugcccgggggaugaaga

SEQ ID NO: 1420 - RNA, 19 nt, Artificial Sequence
  Description of Artificial Sequence: Synthetic iRNA agent targeting human EGLN2 oligonucleotide
ucuucaucccccgggcaug

SEQ ID NO: 1421 - RNA, 19 nt, Artificial Sequence
  Description of Artificial Sequence: Synthetic iRNA agent targeting human EGLN2 oligonucleotide
ugcccgggggaugaagaca

SEQ ID NO: 1422 - RNA, 19 nt, Artificial Sequence
  Description of Artificial Sequence: Synthetic iRNA agent targeting human EGLN2 oligonucleotide
ugucuucaucccccgggca

SEQ ID NO: 1423 - RNA, 19 nt, Artificial Sequence
  Description of Artificial Sequence: Synthetic iRNA agent targeting human EGLN2 oligonucleotide
cccgggggaugaagacacu

SEQ ID NO: 1424 - RNA, 19 nt, Artificial Sequence
  Description of Artificial Sequence: Synthetic iRNA agent targeting human EGLN2 oligonucleotide
agugucuucaucccccggg

SEQ ID NO: 1425 - RNA, 19 nt, Artificial Sequence
  Description of Artificial Sequence: Synthetic iRNA agent targeting human EGLN2 oligonucleotide
gggggaugaagacacugcu

SEQ ID NO: 1426 - RNA, 19 nt, Artificial Sequence
  Description of Artificial Sequence: Synthetic iRNA agent targeting human EGLN2 oligonucleotide
agcagugucuucauccccc

SEQ ID NO: 1427 - RNA, 19 nt, Artificial Sequence
  Description of Artificial Sequence: Synthetic iRNA agent targeting human EGLN2 oligonucleotide
ugccagccgcagccccuaa

SEQ ID NO: 1428 - RNA, 19 nt, Artificial Sequence
  Description of Artificial Sequence: Synthetic iRNA agent targeting human EGLN2 oligonucleotide
uuaggggcugcggcuggca

SEQ ID NO: 1429 - RNA, 19 nt, Artificial Sequence
  Description of Artificial Sequence: Synthetic iRNA agent targeting human EGLN2 oligonucleotide
agccgcagccccuaaguca

SEQ ID NO: 1430 - RNA, 19 nt, Artificial Sequence
  Description of Artificial Sequence: Synthetic iRNA agent targeting human EGLN2 oligonucleotide
ugacuuaggggcugcggcu

SEQ ID NO: 1431 - RNA, 19 nt, Artificial Sequence
  Description of Artificial Sequence: Synthetic iRNA agent targeting human EGLN2 oligonucleotide
gcagccccuaagucaggcu

SEQ ID NO: 1432 - RNA, 19 nt, Artificial Sequence
  Description of Artificial Sequence: Synthetic iRNA agent targeting human EGLN2 oligonucleotide
agccugacuuaggggcugc

SEQ ID NO: 1433 - RNA, 19 nt, Artificial Sequence
  Description of Artificial Sequence: Synthetic iRNA agent targeting human EGLN2 oligonucleotide
agccccuaagucaggcucu

SEQ ID NO: 1434 - RNA, 19 nt, Artificial Sequence
  Description of Artificial Sequence: Synthetic iRNA agent targeting human EGLN2 oligonucleotide
agagccugacuuaggggcu

SEQ ID NO: 1435 - RNA, 19 nt, Artificial Sequence
  Description of Artificial Sequence: Synthetic iRNA agent targeting human EGLN2 oligonucleotide
ccuaagucaggcucucccu

SEQ ID NO: 1436 - RNA, 19 nt, Artificial Sequence
  Description of Artificial Sequence: Synthetic iRNA agent targeting human EGLN2 oligonucleotide
agggagagccugacuuagg

SEQ ID NO: 1437 - RNA, 19 nt, Artificial Sequence
  Description of Artificial Sequence: Synthetic iRNA agent targeting human EGLN2 oligonucleotide
agucaggcucucccucagu

SEQ ID NO: 1438 - RNA, 19 nt, Artificial Sequence
  Description of Artificial Sequence: Synthetic iRNA agent targeting human EGLN2 oligonucleotide
acugagggagagccugacu

SEQ ID NO: 1439 - RNA, 19 nt, Artificial Sequence
  Description of Artificial Sequence: Synthetic iRNA agent targeting human EGLN2 oligonucleotide
gucaggcucucccucaguu

SEQ ID NO: 1440 - RNA, 19 nt, Artificial Sequence
  Description of Artificial Sequence: Synthetic iRNA agent targeting human EGLN2 oligonucleotide
aacugagggagagccugac

SEQ ID NO: 1441 - RNA, 19 nt, Artificial Sequence
  Description of Artificial Sequence: Synthetic iRNA agent targeting human EGLN2 oligonucleotide
ccucaguuaccagggucuu

SEQ ID NO: 1442 - RNA, 19 nt, Artificial Sequence
  Description of Artificial Sequence: Synthetic iRNA agent targeting human EGLN2 oligonucleotide
aagacccugguaacugagg

SEQ ID NO: 1443 - RNA, 19 nt, Artificial Sequence
  Description of Artificial Sequence: Synthetic iRNA agent targeting human EGLN2 oligonucleotide
caguuaccagggucuucgu

SEQ ID NO: 1444 - RNA, 19 nt, Artificial Sequence
  Description of Artificial Sequence: Synthetic iRNA agent targeting human EGLN2 oligonucleotide
acgaagacccugguaacug

SEQ ID NO: 1445 - RNA, 19 nt, Artificial Sequence
  Description of Artificial Sequence: Synthetic iRNA agent targeting human EGLN2 oligonucleotide
guuaccagggucuucguca

SEQ ID NO: 1446 - RNA, 19 nt, Artificial Sequence
  Description of Artificial Sequence: Synthetic iRNA agent targeting human EGLN2 oligonucleotide
ugacgaagacccugguaac

SEQ ID NO: 1447 - RNA, 19 nt, Artificial Sequence
  Description of Artificial Sequence: Synthetic iRNA agent targeting human EGLN2 oligonucleotide
uaccagggucuucgucaga

SEQ ID NO: 1448 - RNA, 19 nt, Artificial Sequence
  Description of Artificial Sequence: Synthetic iRNA agent targeting human EGLN2 oligonucleotide
ucugacgaagacccuggua

SEQ ID NO: 1449 - RNA, 19 nt, Artificial Sequence
  Description of Artificial Sequence: Synthetic iRNA agent targeting human EGLN2 oligonucleotide
ugggaguggagaguuaccu

SEQ ID NO: 1450 - RNA, 19 nt, Artificial Sequence
  Description of Artificial Sequence: Synthetic iRNA agent targeting human EGLN2 oligonucleotide
agguaacucuccacuccca

SEQ ID NO: 1451 - RNA, 19 nt, Artificial Sequence
  Description of Artificial Sequence: Synthetic iRNA agent targeting human EGLN2 oligonucleotide
ccacuguccaggagugccu

SEQ ID NO: 1452 - RNA, 19 nt, Artificial Sequence
  Description of Artificial Sequence: Synthetic iRNA agent targeting human EGLN2 oligonucleotide
aggcacuccuggacagugg

SEQ ID NO: 1453 - RNA, 19 nt, Artificial Sequence
  Description of Artificial Sequence: Synthetic iRNA agent targeting human EGLN2 oligonucleotide
gccuagugaggccucggca

SEQ ID NO: 1454 - RNA, 19 nt, Artificial Sequence
  Description of Artificial Sequence: Synthetic iRNA agent targeting human EGLN2 oligonucleotide
ugccgaggccucacuaggc

SEQ ID NO: 1455 - RNA, 19 nt, Artificial Sequence
  Description of Artificial Sequence: Synthetic iRNA agent targeting human EGLN2 oligonucleotide
cagcccucuucgggacggu

SEQ ID NO: 1456 - RNA, 19 nt, Artificial Sequence
  Description of Artificial Sequence: Synthetic iRNA agent targeting human EGLN2 oligonucleotide
accgucccgaagagggcug

SEQ ID NO: 1457 - RNA, 19 nt, Artificial Sequence
  Description of Artificial Sequence: Synthetic iRNA agent targeting human EGLN2 oligonucleotide
gcccucuucgggacgguuu

SEQ ID NO: 1458 - RNA, 19 nt, Artificial Sequence
  Description of Artificial Sequence: Synthetic iRNA agent targeting human EGLN2 oligonucleotide
aaaccgucccgaagagggc

SEQ ID NO: 1459 - RNA, 19 nt, Artificial Sequence
  Description of Artificial Sequence: Synthetic iRNA agent targeting human EGLN2 oligonucleotide
cccucuucgggacgguuuu

SEQ ID NO: 1460 - RNA, 19 nt, Artificial Sequence
  Description of Artificial Sequence: Synthetic iRNA agent targeting human EGLN2 oligonucleotide
aaaaccgucccgaagaggg

SEQ ID NO: 1461 - RNA, 19 nt, Artificial Sequence
  Description of Artificial Sequence: Synthetic iRNA agent targeting human EGLN2 oligonucleotide
gggacgguuuuggcgggca

SEQ ID NO: 1462 - RNA, 19 nt, Artificial Sequence
  Description of Artificial Sequence: Synthetic iRNA agent targeting human EGLN2 oligonucleotide
ugcccgccaaaaccguccc

SEQ ID NO: 1463 - RNA, 19 nt, Artificial Sequence
  Description of Artificial Sequence: Synthetic iRNA agent targeting human EGLN2 oligonucleotide
cgguuuuggcgggcaggau

SEQ ID NO: 1464 - RNA, 19 nt, Artificial Sequence
  Description of Artificial Sequence: Synthetic iRNA agent targeting human EGLN2 oligonucleotide
auccugcccgccaaaaccg

SEQ ID NO: 1465 - RNA, 19 nt, Artificial Sequence
  Description of Artificial Sequence: Synthetic iRNA agent targeting human EGLN2 oligonucleotide
uuuuggcgggcaggauggu

SEQ ID NO: 1466 - RNA, 19 nt, Artificial Sequence
  Description of Artificial Sequence: Synthetic iRNA agent targeting human EGLN2 oligonucleotide
accauccugcccgccaaaa

SEQ ID NO: 1467 - RNA, 19 nt, Artificial Sequence
  Description of Artificial Sequence: Synthetic iRNA agent targeting human EGLN2 oligonucleotide
gcggccgcugcagagugaa

SEQ ID NO: 1468 - RNA, 19 nt, Artificial Sequence
  Description of Artificial Sequence: Synthetic iRNA agent targeting human EGLN2 oligonucleotide
uucacucugcagcggccgc

SEQ ID NO: 1469 - RNA, 19 nt, Artificial Sequence
  Description of Artificial Sequence: Synthetic iRNA agent targeting human EGLN2 oligonucleotide
gcugcagagugaaggcgcu

SEQ ID NO: 1470 - RNA, 19 nt, Artificial Sequence
  Description of Artificial Sequence: Synthetic iRNA agent targeting human EGLN2 oligonucleotide
agcgccuucacucugcagc

SEQ ID NO: 1471 - RNA, 19 nt, Artificial Sequence
  Description of Artificial Sequence: Synthetic iRNA agent targeting human EGLN2 oligonucleotide
gcugcagcgcuggucacca

SEQ ID NO: 1472 - RNA, 19 nt, Artificial Sequence
  Description of Artificial Sequence: Synthetic iRNA agent targeting human EGLN2 oligonucleotide
uggugaccagcgcugcagc

SEQ ID NO: 1473 - RNA, 19 nt, Artificial Sequence
  Description of Artificial Sequence: Synthetic iRNA agent targeting human EGLN2 oligonucleotide
uggucaccaaggggugcca

SEQ ID NO: 1474 - RNA, 19 nt, Artificial Sequence
  Description of Artificial Sequence: Synthetic iRNA agent targeting human EGLN2 oligonucleotide
uggcaccccuuggugacca

SEQ ID NO: 1475 - RNA, 19 nt, Artificial Sequence
  Description of Artificial Sequence: Synthetic iRNA agent targeting human EGLN2 oligonucleotide
accaaggggugccagcgau

SEQ ID NO: 1476 - RNA, 19 nt, Artificial Sequence
  Description of Artificial Sequence: Synthetic iRNA agent targeting human EGLN2 oligonucleotide
aucgcuggcaccccuuggu

SEQ ID NO: 1477 - RNA, 19 nt, Artificial Sequence
  Description of Artificial Sequence: Synthetic iRNA agent targeting human EGLN2 oligonucleotide
ccaaggggugccagcgauu

SEQ ID NO: 1478 - RNA, 19 nt, Artificial Sequence
  Description of Artificial Sequence: Synthetic iRNA agent targeting human EGLN2 oligonucleotide
aaucgcuggcaccccuugg

SEQ ID NO: 1479 - RNA, 19 nt, Artificial Sequence
  Description of Artificial Sequence: Synthetic iRNA agent targeting human EGLN2 oligonucleotide
ggggugccagcgauuggca

SEQ ID NO: 1480 - RNA, 19 nt, Artificial Sequence
  Description of Artificial Sequence: Synthetic iRNA agent targeting human EGLN2 oligonucleotide
ugccaaucgcuggcacccc

SEQ ID NO: 1481 - RNA, 19 nt, Artificial Sequence
  Description of Artificial Sequence: Synthetic iRNA agent targeting human EGLN2 oligonucleotide
auuggcagcccagggcgca

SEQ ID NO: 1482 - RNA, 19 nt, Artificial Sequence
  Description of Artificial Sequence: Synthetic iRNA agent targeting human EGLN2 oligonucleotide
ugcgcccugggcugccaau

SEQ ID NO: 1483 - RNA, 19 nt, Artificial Sequence
  Description of Artificial Sequence: Synthetic iRNA agent targeting human EGLN2 oligonucleotide
ccugaggcccccaaacgga

SEQ ID NO: 1484 - RNA, 19 nt, Artificial Sequence
  Description of Artificial Sequence: Synthetic iRNA agent targeting human EGLN2 oligonucleotide
uccguuugggggccucagg

SEQ ID NO: 1485 - RNA, 19 nt, Artificial Sequence
  Description of Artificial Sequence: Synthetic iRNA agent targeting human EGLN2 oligonucleotide
cugaggcccccaaacggaa

SEQ ID NO: 1486 - RNA, 19 nt, Artificial Sequence
  Description of Artificial Sequence: Synthetic iRNA agent targeting human EGLN2 oligonucleotide
uuccguuugggggccucag

SEQ ID NO: 1487 - RNA, 19 nt, Artificial Sequence
  Description of Artificial Sequence: Synthetic iRNA agent targeting human EGLN2 oligonucleotide
ugaggcccccaaacggaaa

SEQ ID NO: 1488 - RNA, 19 nt, Artificial Sequence
  Description of Artificial Sequence: Synthetic iRNA agent targeting human EGLN2 oligonucleotide
uuuccguuugggggccuca

SEQ ID NO: 1489 - RNA, 19 nt, Artificial Sequence
  Description of Artificial Sequence: Synthetic iRNA agent targeting human EGLN2 oligonucleotide
gaggcccccaaacggaaau

SEQ ID NO: 1490 - RNA, 19 nt, Artificial Sequence
  Description of Artificial Sequence: Synthetic iRNA agent targeting human EGLN2 oligonucleotide
auuuccguuugggggccuc

SEQ ID NO: 1491 - RNA, 19 nt, Artificial Sequence
  Description of Artificial Sequence: Synthetic iRNA agent targeting human EGLN2 oligonucleotide
aacggaaaugggccgagga

SEQ ID NO: 1492 - RNA, 19 nt, Artificial Sequence
  Description of Artificial Sequence: Synthetic iRNA agent targeting human EGLN2 oligonucleotide
uccucggcccauuuccguu

SEQ ID NO: 1493 - RNA, 19 nt, Artificial Sequence
  Description of Artificial Sequence: Synthetic iRNA agent targeting human EGLN2 oligonucleotide
acggaaaugggccgaggau

SEQ ID NO: 1494 - RNA, 19 nt, Artificial Sequence
  Description of Artificial Sequence: Synthetic iRNA agent targeting human EGLN2 oligonucleotide
auccucggcccauuuccgu

SEQ ID NO: 1495 - RNA, 19 nt, Artificial Sequence
  Description of Artificial Sequence: Synthetic iRNA agent targeting human EGLN2 oligonucleotide
gaaaugggccgaggauggu

SEQ ID NO: 1496 - RNA, 19 nt, Artificial Sequence
  Description of Artificial Sequence: Synthetic iRNA agent targeting human EGLN2 oligonucleotide
accauccucggcccauuuc

SEQ ID NO: 1497 - RNA, 19 nt, Artificial Sequence
  Description of Artificial Sequence: Synthetic iRNA agent targeting human EGLN2 oligonucleotide
ucacccagcaaacggcccu

SEQ ID NO: 1498 - RNA, 19 nt, Artificial Sequence
  Description of Artificial Sequence: Synthetic iRNA agent targeting human EGLN2 oligonucleotide
agggccguuugcuggguga

SEQ ID NO: 1499 - RNA, 19 nt, Artificial Sequence
  Description of Artificial Sequence: Synthetic iRNA agent targeting human EGLN2 oligonucleotide
gggccaggcaagagaacca

SEQ ID NO: 1500 - RNA, 19 nt, Artificial Sequence
  Description of Artificial Sequence: Synthetic iRNA agent targeting human EGLN2 oligonucleotide
ugguucucuugccuggccc

SEQ ID NO: 1501 - RNA, 19 nt, Artificial Sequence
  Description of Artificial Sequence: Synthetic iRNA agent targeting human EGLN2 oligonucleotide
cgcugcccucugcgcccga

SEQ ID NO: 1502 - RNA, 19 nt, Artificial Sequence
  Description of Artificial Sequence: Synthetic iRNA agent targeting human EGLN2 oligonucleotide
ucgggcgcagagggcagcg

SEQ ID NO: 1503 - RNA, 19 nt, Artificial Sequence
  Description of Artificial Sequence: Synthetic iRNA agent targeting human EGLN2 oligonucleotide
gccuggcccuggacuauau

SEQ ID NO: 1504 - RNA, 19 nt, Artificial Sequence
  Description of Artificial Sequence: Synthetic iRNA agent targeting human EGLN2 oligonucleotide
auauaguccagggccaggc

SEQ ID NO: 1505 - RNA, 19 nt, Artificial Sequence
  Description of Artificial Sequence: Synthetic iRNA agent targeting human EGLN2 oligonucleotide
uggcccuggacuauaucgu

SEQ ID NO: 1506 - RNA, 19 nt, Artificial Sequence
  Description of Artificial Sequence: Synthetic iRNA agent targeting human EGLN2 oligonucleotide
acgauauaguccagggcca

SEQ ID NO: 1507 - RNA, 19 nt, Artificial Sequence
  Description of Artificial Sequence: Synthetic iRNA agent targeting human EGLN2 oligonucleotide
gacuauaucgugcccugca

SEQ ID NO: 1508 - RNA, 19 nt, Artificial Sequence
  Description of Artificial Sequence: Synthetic iRNA agent targeting human EGLN2 oligonucleotide
ugcagggcacgauauaguc

SEQ ID NO: 1509 - RNA, 19 nt, Artificial Sequence
  Description of Artificial Sequence: Synthetic iRNA agent targeting human EGLN2 oligonucleotide
acuauaucgugcccugcau

SEQ ID NO: 1510 - RNA, 19 nt, Artificial Sequence
  Description of Artificial Sequence: Synthetic iRNA agent targeting human EGLN2 oligonucleotide
augcagggcacgauauagu

SEQ ID NO: 1511 - RNA, 19 nt, Artificial Sequence
  Description of Artificial Sequence: Synthetic iRNA agent targeting human EGLN2 oligonucleotide
ucgugcccugcaugcggua

SEQ ID NO: 1512 - RNA, 19 nt, Artificial Sequence
  Description of Artificial Sequence: Synthetic iRNA agent targeting human EGLN2 oligonucleotide
uaccgcaugcagggcacga

SEQ ID NO: 1513 - RNA, 19 nt, Artificial Sequence
  Description of Artificial Sequence: Synthetic iRNA agent targeting human EGLN2 oligonucleotide
gugcccugcaugcgguacu

SEQ ID NO: 1514 - RNA, 19 nt, Artificial Sequence
  Description of Artificial Sequence: Synthetic iRNA agent targeting human EGLN2 oligonucleotide
aguaccgcaugcagggcac

SEQ ID NO: 1515 - RNA, 19 nt, Artificial Sequence
  Description of Artificial Sequence: Synthetic iRNA agent targeting human EGLN2 oligonucleotide
ugcccugcaugcgguacua

SEQ ID NO: 1516 - RNA, 19 nt, Artificial Sequence
  Description of Artificial Sequence: Synthetic iRNA agent targeting human EGLN2 oligonucleotide
uaguaccgcaugcagggca

SEQ ID NO: 1517 - RNA, 19 nt, Artificial Sequence
  Description of Artificial Sequence: Synthetic iRNA agent targeting human EGLN2 oligonucleotide
gcaugcgguacuacggcau

SEQ ID NO: 1518 - RNA, 19 nt, Artificial Sequence
  Description of Artificial Sequence: Synthetic iRNA agent targeting human EGLN2 oligonucleotide
augccguaguaccgcaugc

SEQ ID NO: 1519 - RNA, 19 nt, Artificial Sequence
  Description of Artificial Sequence: Synthetic iRNA agent targeting human EGLN2 oligonucleotide
augcgguacuacggcaucu

SEQ ID NO: 1520 - RNA, 19 nt, Artificial Sequence
  Description of Artificial Sequence: Synthetic iRNA agent targeting human EGLN2 oligonucleotide
agaugccguaguaccgcau

SEQ ID NO: 1521 - RNA, 19 nt, Artificial Sequence
  Description of Artificial Sequence: Synthetic iRNA agent targeting human EGLN2 oligonucleotide
gguacuacggcaucugcgu

SEQ ID NO: 1522 - RNA, 19 nt, Artificial Sequence
  Description of Artificial Sequence: Synthetic iRNA agent targeting human EGLN2 oligonucleotide
acgcagaugccguaguacc

SEQ ID NO: 1523 - RNA, 19 nt, Artificial Sequence
  Description of Artificial Sequence: Synthetic iRNA agent targeting human EGLN2 oligonucleotide
uacuacggcaucugcguca

SEQ ID NO: 1524 - RNA, 19 nt, Artificial Sequence
  Description of Artificial Sequence: Synthetic iRNA agent targeting human EGLN2 oligonucleotide
ugacgcagaugccguagua

SEQ ID NO: 1525 - RNA, 19 nt, Artificial Sequence
  Description of Artificial Sequence: Synthetic iRNA agent targeting human EGLN2 oligonucleotide
acggcaucugcgucaagga

SEQ ID NO: 1526 - RNA, 19 nt, Artificial Sequence
  Description of Artificial Sequence: Synthetic iRNA agent targeting human EGLN2 oligonucleotide
uccuugacgcagaugccgu

SEQ ID NO: 1527 - RNA, 19 nt, Artificial Sequence
  Description of Artificial Sequence: Synthetic iRNA agent targeting human EGLN2 oligonucleotide
aucugcgucaaggacagcu

SEQ ID NO: 1528 - RNA, 19 nt, Artificial Sequence
  Description of Artificial Sequence: Synthetic iRNA agent targeting human EGLN2 oligonucleotide
agcuguccuugacgcagau

SEQ ID NO: 1529 - RNA, 19 nt, Artificial Sequence
  Description of Artificial Sequence: Synthetic iRNA agent targeting human EGLN2 oligonucleotide
cagcacugggcggucgcgu

SEQ ID NO: 1530 - RNA, 19 nt, Artificial Sequence
  Description of Artificial Sequence: Synthetic iRNA agent targeting human EGLN2 oligonucleotide
acgcgaccgcccagugcug

SEQ ID NO: 1531 - RNA, 19 nt, Artificial Sequence
  Description of Artificial Sequence: Synthetic iRNA agent targeting human EGLN2 oligonucleotide
cacugggcggucgcgugcu

SEQ ID NO: 1532 - RNA, 19 nt, Artificial Sequence
  Description of Artificial Sequence: Synthetic iRNA agent targeting human EGLN2 oligonucleotide
agcacgcgaccgcccagug

SEQ ID NO: 1533 - RNA, 19 nt, Artificial Sequence
  Description of Artificial Sequence: Synthetic iRNA agent targeting human EGLN2 oligonucleotide
ggaggcccucaaacggggu

SEQ ID NO: 1534 - RNA, 19 nt, Artificial Sequence
  Description of Artificial Sequence: Synthetic iRNA agent targeting human EGLN2 oligonucleotide
accccguuugagggccucc

SEQ ID NO: 1535 - RNA, 19 nt, Artificial Sequence
  Description of Artificial Sequence: Synthetic iRNA agent targeting human EGLN2 oligonucleotide
ucaaacggggugggcgccu

SEQ ID NO: 1536 - RNA, 19 nt, Artificial Sequence
  Description of Artificial Sequence: Synthetic iRNA agent targeting human EGLN2 oligonucleotide
aggcgcccaccccguuuga

SEQ ID NO: 1537 - RNA, 19 nt, Artificial Sequence
  Description of Artificial Sequence: Synthetic iRNA agent targeting human EGLN2 oligonucleotide
acggggugggcgccugcga

SEQ ID NO: 1538 - RNA, 19 nt, Artificial Sequence
  Description of Artificial Sequence: Synthetic iRNA agent targeting human EGLN2 oligonucleotide
ucgcaggcgcccaccccgu

SEQ ID NO: 1539 - RNA, 19 nt, Artificial Sequence
  Description of Artificial Sequence: Synthetic iRNA agent targeting human EGLN2 oligonucleotide
ggcgccugcgagacgggca

SEQ ID NO: 1540 - RNA, 19 nt, Artificial Sequence
  Description of Artificial Sequence: Synthetic iRNA agent targeting human EGLN2 oligonucleotide
ugcccgucucgcaggcgcc

SEQ ID NO: 1541 - RNA, 19 nt, Artificial Sequence
  Description of Artificial Sequence: Synthetic iRNA agent targeting human EGLN2 oligonucleotide
cuagugagccagagggcga

SEQ ID NO: 1542 - RNA, 19 nt, Artificial Sequence
  Description of Artificial Sequence: Synthetic iRNA agent targeting human EGLN2 oligonucleotide
ucgcccucuggcucacuag

SEQ ID NO: 1543 - RNA, 19 nt, Artificial Sequence
  Description of Artificial Sequence: Synthetic iRNA agent targeting human EGLN2 oligonucleotide
uagugagccagagggcgau

SEQ ID NO: 1544 - RNA, 19 nt, Artificial Sequence
  Description of Artificial Sequence: Synthetic iRNA agent targeting human EGLN2 oligonucleotide
aucgcccucuggcucacua

SEQ ID NO: 1545 - RNA, 19 nt, Artificial Sequence
  Description of Artificial Sequence: Synthetic iRNA agent targeting human EGLN2 oligonucleotide
gcgaucccgccgcgcagca

SEQ ID NO: 1546 - RNA, 19 nt, Artificial Sequence
  Description of Artificial Sequence: Synthetic iRNA agent targeting human EGLN2 oligonucleotide
ugcugcgcggcgggaucgc

SEQ ID NO: 1547 - RNA, 19 nt, Artificial Sequence
  Description of Artificial Sequence: Synthetic iRNA agent targeting human EGLN2 oligonucleotide
cgaucccgccgcgcagcau

SEQ ID NO: 1548 - RNA, 19 nt, Artificial Sequence
  Description of Artificial Sequence: Synthetic iRNA agent targeting human EGLN2 oligonucleotide
augcugcgcggcgggaucg

SEQ ID NO: 1549 - RNA, 19 nt, Artificial Sequence
  Description of Artificial Sequence: Synthetic iRNA agent targeting human EGLN2 oligonucleotide
cccgccgcgcagcauccgu

SEQ ID NO: 1550 - RNA, 19 nt, Artificial Sequence
  Description of Artificial Sequence: Synthetic iRNA agent targeting human EGLN2 oligonucleotide
acggaugcugcgcggcggg

SEQ ID NO: 1551 - RNA, 19 nt, Artificial Sequence
  Description of Artificial Sequence: Synthetic iRNA agent targeting human EGLN2 oligonucleotide
cgcgcagcauccgugggga

SEQ ID NO: 1552 - RNA, 19 nt, Artificial Sequence
  Description of Artificial Sequence: Synthetic iRNA agent targeting human EGLN2 oligonucleotide
uccccacggaugcugcgcg

SEQ ID NO: 1553 - RNA, 19 nt, Artificial Sequence
  Description of Artificial Sequence: Synthetic iRNA agent targeting human EGLN2 oligonucleotide
cauccguggggaccagauu

SEQ ID NO: 1554 - RNA, 19 nt, Artificial Sequence
  Description of Artificial Sequence: Synthetic iRNA agent targeting human EGLN2 oligonucleotide
aaucugguccccacggaug

SEQ ID NO: 1555 - RNA, 19 nt, Artificial Sequence
  Description of Artificial Sequence: Synthetic iRNA agent targeting human EGLN2 oligonucleotide
ccagauugccuggguggaa

SEQ ID NO: 1556 - RNA, 19 nt, Artificial Sequence
  Description of Artificial Sequence: Synthetic iRNA agent targeting human EGLN2 oligonucleotide
uuccacccaggcaaucugg

SEQ ID NO: 1557 - RNA, 19 nt, Artificial Sequence
  Description of Artificial Sequence: Synthetic iRNA agent targeting human EGLN2 oligonucleotide
ccuggguggaaggccauga

SEQ ID NO: 1558 - RNA, 19 nt, Artificial Sequence
  Description of Artificial Sequence: Synthetic iRNA agent targeting human EGLN2 oligonucleotide
ucauggccuuccacccagg

SEQ ID NO: 1559 - RNA, 19 nt, Artificial Sequence
  Description of Artificial Sequence: Synthetic iRNA agent targeting human EGLN2 oligonucleotide
cuggguggaaggccaugaa

SEQ ID NO: 1560 - RNA, 19 nt, Artificial Sequence
  Description of Artificial Sequence: Synthetic iRNA agent targeting human EGLN2 oligonucleotide
uucauggccuuccacccag

SEQ ID NO: 1561 - RNA, 19 nt, Artificial Sequence
  Description of Artificial Sequence: Synthetic iRNA agent targeting human EGLN2 oligonucleotide
ccaugaaccaggcugucga

SEQ ID NO: 1562 - RNA, 19 nt, Artificial Sequence
  Description of Artificial Sequence: Synthetic iRNA agent targeting human EGLN2 oligonucleotide
ucgacagccugguucaugg

SEQ ID NO: 1563 - RNA, 19 nt, Artificial Sequence
  Description of Artificial Sequence: Synthetic iRNA agent targeting human EGLN2 oligonucleotide
caugaaccaggcugucgaa

SEQ ID NO: 1564 - RNA, 19 nt, Artificial Sequence
  Description of Artificial Sequence: Synthetic iRNA agent targeting human EGLN2 oligonucleotide
uucgacagccugguucaug

SEQ ID NO: 1565 - RNA, 19 nt, Artificial Sequence
  Description of Artificial Sequence: Synthetic iRNA agent targeting human EGLN2 oligonucleotide
gaaccaggcugucgaagca

SEQ ID NO: 1566 - RNA, 19 nt, Artificial Sequence
  Description of Artificial Sequence: Synthetic iRNA agent targeting human EGLN2 oligonucleotide
ugcuucgacagccugguuc

SEQ ID NO: 1567 - RNA, 19 nt, Artificial Sequence
  Description of Artificial Sequence: Synthetic iRNA agent targeting human EGLN2 oligonucleotide
aggcugucgaagcauuggu

SEQ ID NO: 1568 - RNA, 19 nt, Artificial Sequence
  Description of Artificial Sequence: Synthetic iRNA agent targeting human EGLN2 oligonucleotide
accaaugcuucgacagccu

SEQ ID NO: 1569 - RNA, 19 nt, Artificial Sequence
  Description of Artificial Sequence: Synthetic iRNA agent targeting human EGLN2 oligonucleotide
gucgaagcauuggugcccu

SEQ ID NO: 1570 - RNA, 19 nt, Artificial Sequence
  Description of Artificial Sequence: Synthetic iRNA agent targeting human EGLN2 oligonucleotide
agggcaccaaugcuucgac

SEQ ID NO: 1571 - RNA, 19 nt, Artificial Sequence
  Description of Artificial Sequence: Synthetic iRNA agent targeting human EGLN2 oligonucleotide
cgaagcauuggugcccuca

SEQ ID NO: 1572 - RNA, 19 nt, Artificial Sequence
  Description of Artificial Sequence: Synthetic iRNA agent targeting human EGLN2 oligonucleotide
ugagggcaccaaugcuucg

SEQ ID NO: 1573 - RNA, 19 nt, Artificial Sequence
  Description of Artificial Sequence: Synthetic iRNA agent targeting human EGLN2 oligonucleotide
gaagcauuggugcccucau

SEQ ID NO: 1574 - RNA, 19 nt, Artificial Sequence
  Description of Artificial Sequence: Synthetic iRNA agent targeting human EGLN2 oligonucleotide
augagggcaccaaugcuuc

SEQ ID NO: 1575 - RNA, 19 nt, Artificial Sequence
  Description of Artificial Sequence: Synthetic iRNA agent targeting human EGLN2 oligonucleotide
gugcccucauggcccaugu

SEQ ID NO: 1576 - RNA, 19 nt, Artificial Sequence
  Description of Artificial Sequence: Synthetic iRNA agent targeting human EGLN2 oligonucleotide
acaugggccaugagggcac

SEQ ID NO: 1577 - RNA, 19 nt, Artificial Sequence
  Description of Artificial Sequence: Synthetic iRNA agent targeting human EGLN2 oligonucleotide
cccauguggacgccgucau

SEQ ID NO: 1578 - RNA, 19 nt, Artificial Sequence
  Description of Artificial Sequence: Synthetic iRNA agent targeting human EGLN2 oligonucleotide
augacggcguccacauggg

SEQ ID NO: 1579 - RNA, 19 nt, Artificial Sequence
  Description of Artificial Sequence: Synthetic iRNA agent targeting human EGLN2 oligonucleotide
uggacgccgucauccgcca

SEQ ID NO: 1580 - RNA, 19 nt, Artificial Sequence
  Description of Artificial Sequence: Synthetic iRNA agent targeting human EGLN2 oligonucleotide
uggcggaugacggcgucca

SEQ ID NO: 1581 - RNA, 19 nt, Artificial Sequence
  Description of Artificial Sequence: Synthetic iRNA agent targeting human EGLN2 oligonucleotide
gacgccgucauccgccacu

SEQ ID NO: 1582 - RNA, 19 nt, Artificial Sequence
  Description of Artificial Sequence: Synthetic iRNA agent targeting human EGLN2 oligonucleotide
aguggcggaugacggcguc

SEQ ID NO: 1583 - RNA, 19 nt, Artificial Sequence
  Description of Artificial Sequence: Synthetic iRNA agent targeting human EGLN2 oligonucleotide
cagggcggcugggcagcua

SEQ ID NO: 1584 - RNA, 19 nt, Artificial Sequence
  Description of Artificial Sequence: Synthetic iRNA agent targeting human EGLN2 oligonucleotide
uagcugcccagccgcccug

SEQ ID NO: 1585 - RNA, 19 nt, Artificial Sequence
  Description of Artificial Sequence: Synthetic iRNA agent targeting human EGLN2 oligonucleotide
ggcggcugggcagcuaugu

SEQ ID NO: 1586 - RNA, 19 nt, Artificial Sequence
  Description of Artificial Sequence: Synthetic iRNA agent targeting human EGLN2 oligonucleotide
acauagcugcccagccgcc

SEQ ID NO: 1587 - RNA, 19 nt, Artificial Sequence
  Description of Artificial Sequence: Synthetic iRNA agent targeting human EGLN2 oligonucleotide
ggcugggcagcuaugucau

SEQ ID NO: 1588 - RNA, 19 nt, Artificial Sequence
  Description of Artificial Sequence: Synthetic iRNA agent targeting human EGLN2 oligonucleotide
augacauagcugcccagcc

SEQ ID NO: 1589 - RNA, 19 nt, Artificial Sequence
  Description of Artificial Sequence: Synthetic iRNA agent targeting human EGLN2 oligonucleotide
uaugucaucaacgggcgca

SEQ ID NO: 1590 - RNA, 19 nt, Artificial Sequence
  Description of Artificial Sequence: Synthetic iRNA agent targeting human EGLN2 oligonucleotide
ugcgcccguugaugacaua

SEQ ID NO: 1591 - RNA, 19 nt, Artificial Sequence
  Description of Artificial Sequence: Synthetic iRNA agent targeting human EGLN2 oligonucleotide
gucaucaacgggcgcacca

SEQ ID NO: 1592 - RNA, 19 nt, Artificial Sequence
  Description of Artificial Sequence: Synthetic iRNA agent targeting human EGLN2 oligonucleotide
uggugcgcccguugaugac

SEQ ID NO: 1593 - RNA, 19 nt, Artificial Sequence
  Description of Artificial Sequence: Synthetic iRNA agent targeting human EGLN2 oligonucleotide
ucaucaacgggcgcaccaa

SEQ ID NO: 1594 - RNA, 19 nt, Artificial Sequence
  Description of Artificial Sequence: Synthetic iRNA agent targeting human EGLN2 oligonucleotide
uuggugcgcccguugauga

SEQ ID NO: 1595 - RNA, 19 nt, Artificial Sequence
  Description of Artificial Sequence: Synthetic iRNA agent targeting human EGLN2 oligonucleotide
aacgggcgcaccaaggcca

SEQ ID NO: 1596 - RNA, 19 nt, Artificial Sequence
  Description of Artificial Sequence: Synthetic iRNA agent targeting human EGLN2 oligonucleotide
uggccuuggugcgcccguu

SEQ ID NO: 1597 - RNA, 19 nt, Artificial Sequence
  Description of Artificial Sequence: Synthetic iRNA agent targeting human EGLN2 oligonucleotide
caaggccaugguggcgugu

SEQ ID NO: 1598 - RNA, 19 nt, Artificial Sequence
  Description of Artificial Sequence: Synthetic iRNA agent targeting human EGLN2 oligonucleotide
acacgccaccauggccuug

SEQ ID NO: 1599 - RNA, 19 nt, Artificial Sequence
  Description of Artificial Sequence: Synthetic iRNA agent targeting human EGLN2 oligonucleotide
caugguggcguguuaccca

SEQ ID NO: 1600 - RNA, 19 nt, Artificial Sequence
  Description of Artificial Sequence: Synthetic iRNA agent targeting human EGLN2 oligonucleotide
uggguaacacgccaccaug

SEQ ID NO: 1601 - RNA, 19 nt, Artificial Sequence
  Description of Artificial Sequence: Synthetic iRNA agent targeting human EGLN2 oligonucleotide
uggcguguuacccaggcaa

SEQ ID NO: 1602 - RNA, 19 nt, Artificial Sequence
  Description of Artificial Sequence: Synthetic iRNA agent targeting human EGLN2 oligonucleotide
uugccuggguaacacgcca

SEQ ID NO: 1603 - RNA, 19 nt, Artificial Sequence
  Description of Artificial Sequence: Synthetic iRNA agent targeting human EGLN2 oligonucleotide
guuacccaggcaacgggcu

SEQ ID NO: 1604 - RNA, 19 nt, Artificial Sequence
  Description of Artificial Sequence: Synthetic iRNA agent targeting human EGLN2 oligonucleotide
agcccguugccuggguaac

SEQ ID NO: 1605 - RNA, 19 nt, Artificial Sequence
  Description of Artificial Sequence: Synthetic iRNA agent targeting human EGLN2 oligonucleotide
ccaggcaacgggcucgggu

SEQ ID NO: 1606 - RNA, 19 nt, Artificial Sequence
  Description of Artificial Sequence: Synthetic iRNA agent targeting human EGLN2 oligonucleotide
acccgagcccguugccugg

SEQ ID NO: 1607 - RNA, 19 nt, Artificial Sequence
  Description of Artificial Sequence: Synthetic iRNA agent targeting human EGLN2 oligonucleotide
caggcaacgggcucgggua

SEQ ID NO: 1608 - RNA, 19 nt, Artificial Sequence
  Description of Artificial Sequence: Synthetic iRNA agent targeting human EGLN2 oligonucleotide
uacccgagcccguugccug

SEQ ID NO: 1609 - RNA, 19 nt, Artificial Sequence
  Description of Artificial Sequence: Synthetic iRNA agent targeting human EGLN2 oligonucleotide
gcaacgggcucggguacgu

SEQ ID NO: 1610 - RNA, 19 nt, Artificial Sequence
  Description of Artificial Sequence: Synthetic iRNA agent targeting human EGLN2 oligonucleotide
acguacccgagcccguugc

SEQ ID NO: 1611 - RNA, 19 nt, Artificial Sequence
  Description of Artificial Sequence: Synthetic iRNA agent targeting human EGLN2 oligonucleotide
caacgggcucggguacgua

SEQ ID NO: 1612 - RNA, 19 nt, Artificial Sequence
  Description of Artificial Sequence: Synthetic iRNA agent targeting human EGLN2 oligonucleotide
uacguacccgagcccguug

SEQ ID NO: 1613 - RNA, 19 nt, Artificial Sequence
  Description of Artificial Sequence: Synthetic iRNA agent targeting human EGLN2 oligonucleotide
aacgggcucggguacguaa

SEQ ID NO: 1614 - RNA, 19 nt, Artificial Sequence
  Description of Artificial Sequence: Synthetic iRNA agent targeting human EGLN2 oligonucleotide
uuacguacccgagcccguu

SEQ ID NO: 1615 - RNA, 19 nt, Artificial Sequence
  Description of Artificial Sequence: Synthetic iRNA agent targeting human EGLN2 oligonucleotide
ggcucggguacguaaggca

SEQ ID NO: 1616 - RNA, 19 nt, Artificial Sequence
  Description of Artificial Sequence: Synthetic iRNA agent targeting human EGLN2 oligonucleotide
ugccuuacguacccgagcc

SEQ ID NO: 1617 - RNA, 19 nt, Artificial Sequence
  Description of Artificial Sequence: Synthetic iRNA agent targeting human EGLN2 oligonucleotide
ucggguacguaaggcacgu

SEQ ID NO: 1618 - RNA, 19 nt, Artificial Sequence
  Description of Artificial Sequence: Synthetic iRNA agent targeting human EGLN2 oligonucleotide
acgugccuuacguacccga

SEQ ID NO: 1619 - RNA, 19 nt, Artificial Sequence
  Description of Artificial Sequence: Synthetic iRNA agent targeting human EGLN2 oligonucleotide
cggguacguaaggcacguu

SEQ ID NO: 1620 - RNA, 19 nt, Artificial Sequence
  Description of Artificial Sequence: Synthetic iRNA agent targeting human EGLN2 oligonucleotide
aacgugccuuacguacccg

SEQ ID NO: 1621 - RNA, 19 nt, Artificial Sequence
  Description of Artificial Sequence: Synthetic iRNA agent targeting human EGLN2 oligonucleotide
gguacguaaggcacguuga

SEQ ID NO: 1622 - RNA, 19 nt, Artificial Sequence
  Description of Artificial Sequence: Synthetic iRNA agent targeting human EGLN2 oligonucleotide
ucaacgugccuuacguacc

SEQ ID NO: 1623 - RNA, 19 nt, Artificial Sequence
  Description of Artificial Sequence: Synthetic iRNA agent targeting human EGLN2 oligonucleotide
uacguaaggcacguugaca

SEQ ID NO: 1624 - RNA, 19 nt, Artificial Sequence
  Description of Artificial Sequence: Synthetic iRNA agent targeting human EGLN2 oligonucleotide
ugucaacgugccuuacgua

SEQ ID NO: 1625 - RNA, 19 nt, Artificial Sequence
  Description of Artificial Sequence: Synthetic iRNA agent targeting human EGLN2 oligonucleotide
acguaaggcacguugacaa

SEQ ID NO: 1626 - RNA, 19 nt, Artificial Sequence
  Description of Artificial Sequence: Synthetic iRNA agent targeting human EGLN2 oligonucleotide
uugucaacgugccuuacgu

SEQ ID NO: 1627 - RNA, 19 nt, Artificial Sequence
  Description of Artificial Sequence: Synthetic iRNA agent targeting human EGLN2 oligonucleotide
cguaaggcacguugacaau

SEQ ID NO: 1628 - RNA, 19 nt, Artificial Sequence
  Description of Artificial Sequence: Synthetic iRNA agent targeting human EGLN2 oligonucleotide
auugucaacgugccuuacg

SEQ ID NO: 1629 - RNA, 19 nt, Artificial Sequence
  Description of Artificial Sequence: Synthetic iRNA agent targeting human EGLN2 oligonucleotide
uugacaauccccacggcga

SEQ ID NO: 1630 - RNA, 19 nt, Artificial Sequence
  Description of Artificial Sequence: Synthetic iRNA agent targeting human EGLN2 oligonucleotide
ucgccguggggauugucaa

SEQ ID NO: 1631 - RNA, 19 nt, Artificial Sequence
  Description of Artificial Sequence: Synthetic iRNA agent targeting human EGLN2 oligonucleotide
ugacaauccccacggcgau

SEQ ID NO: 1632 - RNA, 19 nt, Artificial Sequence
  Description of Artificial Sequence: Synthetic iRNA agent targeting human EGLN2 oligonucleotide
aucgccguggggauuguca

SEQ ID NO: 1633 - RNA, 19 nt, Artificial Sequence
  Description of Artificial Sequence: Synthetic iRNA agent targeting human EGLN2 oligonucleotide
cacggcgaugggcgcugca

SEQ ID NO: 1634 - RNA, 19 nt, Artificial Sequence
  Description of Artificial Sequence: Synthetic iRNA agent targeting human EGLN2 oligonucleotide
ugcagcgcccaucgccgug

SEQ ID NO: 1635 - RNA, 19 nt, Artificial Sequence
  Description of Artificial Sequence: Synthetic iRNA agent targeting human EGLN2 oligonucleotide
gggcgcugcaucaccugua

SEQ ID NO: 1636 - RNA, 19 nt, Artificial Sequence
  Description of Artificial Sequence: Synthetic iRNA agent targeting human EGLN2 oligonucleotide
uacaggugaugcagcgccc

SEQ ID NO: 1637 - RNA, 19 nt, Artificial Sequence
  Description of Artificial Sequence: Synthetic iRNA agent targeting human EGLN2 oligonucleotide
ggcgcugcaucaccuguau

SEQ ID NO: 1638 - RNA, 19 nt, Artificial Sequence
  Description of Artificial Sequence: Synthetic iRNA agent targeting human EGLN2 oligonucleotide
auacaggugaugcagcgcc

SEQ ID NO: 1639 - RNA, 19 nt, Artificial Sequence
  Description of Artificial Sequence: Synthetic iRNA agent targeting human EGLN2 oligonucleotide
cgcugcaucaccuguaucu

SEQ ID NO: 1640 - RNA, 19 nt, Artificial Sequence
  Description of Artificial Sequence: Synthetic iRNA agent targeting human EGLN2 oligonucleotide
agauacaggugaugcagcg

SEQ ID NO: 1641 - RNA, 19 nt, Artificial Sequence
  Description of Artificial Sequence: Synthetic iRNA agent targeting human EGLN2 oligonucleotide
ugcaucaccuguaucuauu

SEQ ID NO: 1642 - RNA, 19 nt, Artificial Sequence
  Description of Artificial Sequence: Synthetic iRNA agent targeting human EGLN2 oligonucleotide
aauagauacaggugaugca

SEQ ID NO: 1643 - RNA, 19 nt, Artificial Sequence
  Description of Artificial Sequence: Synthetic iRNA agent targeting human EGLN2 oligonucleotide
gcaucaccuguaucuauua

SEQ ID NO: 1644 - RNA, 19 nt, Artificial Sequence
  Description of Artificial Sequence: Synthetic iRNA agent targeting human EGLN2 oligonucleotide
uaauagauacaggugaugc

SEQ ID NO: 1645 - RNA, 19 nt, Artificial Sequence
  Description of Artificial Sequence: Synthetic iRNA agent targeting human EGLN2 oligonucleotide
ucaccuguaucuauuaccu

SEQ ID NO: 1646 - RNA, 19 nt, Artificial Sequence
  Description of Artificial Sequence: Synthetic iRNA agent targeting human EGLN2 oligonucleotide
agguaauagauacagguga

SEQ ID NO: 1647 - RNA, 19 nt, Artificial Sequence
  Description of Artificial Sequence: Synthetic iRNA agent targeting human EGLN2 oligonucleotide
accuguaucuauuaccuga

SEQ ID NO: 1648 - RNA, 19 nt, Artificial Sequence
  Description of Artificial Sequence: Synthetic iRNA agent targeting human EGLN2 oligonucleotide
ucagguaauagauacaggu

SEQ ID NO: 1649 - RNA, 19 nt, Artificial Sequence
  Description of Artificial Sequence: Synthetic iRNA agent targeting human EGLN2 oligonucleotide
ccuguaucuauuaccugaa

SEQ ID NO: 1650 - RNA, 19 nt, Artificial Sequence
  Description of Artificial Sequence: Synthetic iRNA agent targeting human EGLN2 oligonucleotide
uucagguaauagauacagg

SEQ ID NO: 1651 - RNA, 19 nt, Artificial Sequence
  Description of Artificial Sequence: Synthetic iRNA agent targeting human EGLN2 oligonucleotide
guaucuauuaccugaauca

SEQ ID NO: 1652 - RNA, 19 nt, Artificial Sequence
  Description of Artificial Sequence: Synthetic iRNA agent targeting human EGLN2 oligonucleotide
ugauucagguaauagauac

SEQ ID NO: 1653 - RNA, 19 nt, Artificial Sequence
  Description of Artificial Sequence: Synthetic iRNA agent targeting human EGLN2 oligonucleotide
aucuauuaccugaaucaga

SEQ ID NO: 1654 - RNA, 19 nt, Artificial Sequence
  Description of Artificial Sequence: Synthetic iRNA agent targeting human EGLN2 oligonucleotide
ucugauucagguaauagau

SEQ ID NO: 1655 - RNA, 19 nt, Artificial Sequence
  Description of Artificial Sequence: Synthetic iRNA agent targeting human EGLN2 oligonucleotide
uauuaccugaaucagaacu

SEQ ID NO: 1656 - RNA, 19 nt, Artificial Sequence
  Description of Artificial Sequence: Synthetic iRNA agent targeting human EGLN2 oligonucleotide
aguucugauucagguaaua

SEQ ID NO: 1657 - RNA, 19 nt, Artificial Sequence
  Description of Artificial Sequence: Synthetic iRNA agent targeting human EGLN2 oligonucleotide
ugaaucagaacugggacgu

SEQ ID NO: 1658 - RNA, 19 nt, Artificial Sequence
  Description of Artificial Sequence: Synthetic iRNA agent targeting human EGLN2 oligonucleotide
acgucccaguucugauuca

SEQ ID NO: 1659 - RNA, 19 nt, Artificial Sequence
  Description of Artificial Sequence: Synthetic iRNA agent targeting human EGLN2 oligonucleotide
gaaucagaacugggacguu

SEQ ID NO: 1660 - RNA, 19 nt, Artificial Sequence
  Description of Artificial Sequence: Synthetic iRNA agent targeting human EGLN2 oligonucleotide
aacgucccaguucugauuc

SEQ ID NO: 1661 - RNA, 19 nt, Artificial Sequence
  Description of Artificial Sequence: Synthetic iRNA agent targeting human EGLN2 oligonucleotide
aaucagaacugggacguua

SEQ ID NO: 1662 - RNA, 19 nt, Artificial Sequence
  Description of Artificial Sequence: Synthetic iRNA agent targeting human EGLN2 oligonucleotide
uaacgucccaguucugauu

SEQ ID NO: 1663 - RNA, 19 nt, Artificial Sequence
  Description of Artificial Sequence: Synthetic iRNA agent targeting human EGLN2 oligonucleotide
aucagaacugggacguuaa

SEQ ID NO: 1664 - RNA, 19 nt, Artificial Sequence
  Description of Artificial Sequence: Synthetic iRNA agent targeting human EGLN2 oligonucleotide
uuaacgucccaguucugau

SEQ ID NO: 1665 - RNA, 19 nt, Artificial Sequence
  Description of Artificial Sequence: Synthetic iRNA agent targeting human EGLN2 oligonucleotide
agaacugggacguuaaggu

SEQ ID NO: 1666 - RNA, 19 nt, Artificial Sequence
  Description of Artificial Sequence: Synthetic iRNA agent targeting human EGLN2 oligonucleotide
accuuaacgucccaguucu

SEQ ID NO: 1667 - RNA, 19 nt, Artificial Sequence
  Description of Artificial Sequence: Synthetic iRNA agent targeting human EGLN2 oligonucleotide
acugggacguuaaggugca

SEQ ID NO: 1668 - RNA, 19 nt, Artificial Sequence
  Description of Artificial Sequence: Synthetic iRNA agent targeting human EGLN2 oligonucleotide
ugcaccuuaacgucccagu

SEQ ID NO: 1669 - RNA, 19 nt, Artificial Sequence
  Description of Artificial Sequence: Synthetic iRNA agent targeting human EGLN2 oligonucleotide
cugggacguuaaggugcau

SEQ ID NO: 1670 - RNA, 19 nt, Artificial Sequence
  Description of Artificial Sequence: Synthetic iRNA agent targeting human EGLN2 oligonucleotide
augcaccuuaacgucccag

SEQ ID NO: 1671 - RNA, 19 nt, Artificial Sequence
  Description of Artificial Sequence: Synthetic iRNA agent targeting human EGLN2 oligonucleotide
uuaaggugcauggcggccu

SEQ ID NO: 1672 - RNA, 19 nt, Artificial Sequence
  Description of Artificial Sequence: Synthetic iRNA agent targeting human EGLN2 oligonucleotide
aggccgccaugcaccuuaa

SEQ ID NO: 1673 - RNA, 19 nt, Artificial Sequence
  Description of Artificial Sequence: Synthetic iRNA agent targeting human EGLN2 oligonucleotide
aggugcauggcggccugcu

SEQ ID NO: 1674 - RNA, 19 nt, Artificial Sequence
  Description of Artificial Sequence: Synthetic iRNA agent targeting human EGLN2 oligonucleotide
agcaggccgccaugcaccu

SEQ ID NO: 1675 - RNA, 19 nt, Artificial Sequence
  Description of Artificial Sequence: Synthetic iRNA agent targeting human EGLN2 oligonucleotide
ggccggcccgugguagcca

SEQ ID NO: 1676 - RNA, 19 nt, Artificial Sequence
  Description of Artificial Sequence: Synthetic iRNA agent targeting human EGLN2 oligonucleotide
uggcuaccacgggccggcc

SEQ ID NO: 1677 - RNA, 19 nt, Artificial Sequence
  Description of Artificial Sequence: Synthetic iRNA agent targeting human EGLN2 oligonucleotide
gccggcccgugguagccaa

SEQ ID NO: 1678 - RNA, 19 nt, Artificial Sequence
  Description of Artificial Sequence: Synthetic iRNA agent targeting human EGLN2 oligonucleotide
uuggcuaccacgggccggc

SEQ ID NO: 1679 - RNA, 19 nt, Artificial Sequence
  Description of Artificial Sequence: Synthetic iRNA agent targeting human EGLN2 oligonucleotide
cggcccgugguagccaaca

SEQ ID NO: 1680 - RNA, 19 nt, Artificial Sequence
  Description of Artificial Sequence: Synthetic iRNA agent targeting human EGLN2 oligonucleotide
uguuggcuaccacgggccg

SEQ ID NO: 1681 - RNA, 19 nt, Artificial Sequence
  Description of Artificial Sequence: Synthetic iRNA agent targeting human EGLN2 oligonucleotide
ggcccgugguagccaacau

SEQ ID NO: 1682 - RNA, 19 nt, Artificial Sequence
  Description of Artificial Sequence: Synthetic iRNA agent targeting human EGLN2 oligonucleotide
auguuggcuaccacgggcc

SEQ ID NO: 1683 - RNA, 19 nt, Artificial Sequence
  Description of Artificial Sequence: Synthetic iRNA agent targeting human EGLN2 oligonucleotide
gccaacaucgagccacucu

SEQ ID NO: 1684 - RNA, 19 nt, Artificial Sequence
  Description of Artificial Sequence: Synthetic iRNA agent targeting human EGLN2 oligonucleotide
agaguggcucgauguuggc

SEQ ID NO: 1685 - RNA, 19 nt, Artificial Sequence
  Description of Artificial Sequence: Synthetic iRNA agent targeting human EGLN2 oligonucleotide
ccaacaucgagccacucuu

SEQ ID NO: 1686 - RNA, 19 nt, Artificial Sequence
  Description of Artificial Sequence: Synthetic iRNA agent targeting human EGLN2 oligonucleotide
aagaguggcucgauguugg

SEQ ID NO: 1687 - RNA, 19 nt, Artificial Sequence
  Description of Artificial Sequence: Synthetic iRNA agent targeting human EGLN2 oligonucleotide
caacaucgagccacucuuu

SEQ ID NO: 1688 - RNA, 19 nt, Artificial Sequence
  Description of Artificial Sequence: Synthetic iRNA agent targeting human EGLN2 oligonucleotide
aaagaguggcucgauguug

SEQ ID NO: 1689 - RNA, 19 nt, Artificial Sequence
  Description of Artificial Sequence: Synthetic iRNA agent targeting human EGLN2 oligonucleotide
acaucgagccacucuuuga

SEQ ID NO: 1690 - RNA, 19 nt, Artificial Sequence
  Description of Artificial Sequence: Synthetic iRNA agent targeting human EGLN2 oligonucleotide
ucaaagaguggcucgaugu

SEQ ID NO: 1691 - RNA, 19 nt, Artificial Sequence
  Description of Artificial Sequence: Synthetic iRNA agent targeting human EGLN2 oligonucleotide
gagccacucuuugaccggu

SEQ ID NO: 1692 - RNA, 19 nt, Artificial Sequence
  Description of Artificial Sequence: Synthetic iRNA agent targeting human EGLN2 oligonucleotide
accggucaaagaguggcuc

SEQ ID NO: 1693 - RNA, 19 nt, Artificial Sequence
  Description of Artificial Sequence: Synthetic iRNA agent targeting human EGLN2 oligonucleotide
agccacucuuugaccgguu

SEQ ID NO: 1694 - RNA, 19 nt, Artificial Sequence
  Description of Artificial Sequence: Synthetic iRNA agent targeting human EGLN2 oligonucleotide
aaccggucaaagaguggcu

SEQ ID NO: 1695 - RNA, 19 nt, Artificial Sequence
  Description of Artificial Sequence: Synthetic iRNA agent targeting human EGLN2 oligonucleotide
cacucuuugaccgguugcu

SEQ ID NO: 1696 - RNA, 19 nt, Artificial Sequence
  Description of Artificial Sequence: Synthetic iRNA agent targeting human EGLN2 oligonucleotide
agcaaccggucaaagagug

SEQ ID NO: 1697 - RNA, 19 nt, Artificial Sequence
  Description of Artificial Sequence: Synthetic iRNA agent targeting human EGLN2 oligonucleotide
cucuuugaccgguugcuca

SEQ ID NO: 1698 - RNA, 19 nt, Artificial Sequence
  Description of Artificial Sequence: Synthetic iRNA agent targeting human EGLN2 oligonucleotide
ugagcaaccggucaaagag

SEQ ID NO: 1699 - RNA, 19 nt, Artificial Sequence
  Description of Artificial Sequence: Synthetic iRNA agent targeting human EGLN2 oligonucleotide
ucuuugaccgguugcucau

SEQ ID NO: 1700 - RNA, 19 nt, Artificial Sequence
  Description of Artificial Sequence: Synthetic iRNA agent targeting human EGLN2 oligonucleotide
augagcaaccggucaaaga

SEQ ID NO: 1701 - RNA, 19 nt, Artificial Sequence
  Description of Artificial Sequence: Synthetic iRNA agent targeting human EGLN2 oligonucleotide
cuuugaccgguugcucauu

SEQ ID NO: 1702 - RNA, 19 nt, Artificial Sequence
  Description of Artificial Sequence: Synthetic iRNA agent targeting human EGLN2 oligonucleotide
aaugagcaaccggucaaag

SEQ ID NO: 1703 - RNA, 19 nt, Artificial Sequence
  Description of Artificial Sequence: Synthetic iRNA agent targeting human EGLN2 oligonucleotide
uuugaccgguugcucauuu

SEQ ID NO: 1704 - RNA, 19 nt, Artificial Sequence
  Description of Artificial Sequence: Synthetic iRNA agent targeting human EGLN2 oligonucleotide
aaaugagcaaccggucaaa

SEQ ID NO: 1705 - RNA, 19 nt, Artificial Sequence
  Description of Artificial Sequence: Synthetic iRNA agent targeting human EGLN2 oligonucleotide
gaccgguugcucauuuucu

SEQ ID NO: 1706 - RNA, 19 nt, Artificial Sequence
  Description of Artificial Sequence: Synthetic iRNA agent targeting human EGLN2 oligonucleotide
agaaaaugagcaaccgguc

SEQ ID NO: 1707 - RNA, 19 nt, Artificial Sequence
  Description of Artificial Sequence: Synthetic iRNA agent targeting human EGLN2 oligonucleotide
ucuggucugaccggcggaa

SEQ ID NO: 1708 - RNA, 19 nt, Artificial Sequence
  Description of Artificial Sequence: Synthetic iRNA agent targeting human EGLN2 oligonucleotide
uuccgccggucagaccaga

SEQ ID NO: 1709 - RNA, 19 nt, Artificial Sequence
  Description of Artificial Sequence: Synthetic iRNA agent targeting human EGLN2 oligonucleotide
cugaccggcggaaccccca

SEQ ID NO: 1710 - RNA, 19 nt, Artificial Sequence
  Description of Artificial Sequence: Synthetic iRNA agent targeting human EGLN2 oligonucleotide
uggggguuccgccggucag

SEQ ID NO: 1711 - RNA, 19 nt, Artificial Sequence
  Description of Artificial Sequence: Synthetic iRNA agent targeting human EGLN2 oligonucleotide
accggcggaacccccacga

SEQ ID NO: 1712 - RNA, 19 nt, Artificial Sequence
  Description of Artificial Sequence: Synthetic iRNA agent targeting human EGLN2 oligonucleotide
ucguggggguuccgccggu

SEQ ID NO: 1713 - RNA, 19 nt, Artificial Sequence
  Description of Artificial Sequence: Synthetic iRNA agent targeting human EGLN2 oligonucleotide
ggcggaacccccacgaggu

SEQ ID NO: 1714 - RNA, 19 nt, Artificial Sequence
  Description of Artificial Sequence: Synthetic iRNA agent targeting human EGLN2 oligonucleotide
accucguggggguuccgcc

SEQ ID NO: 1715 - RNA, 19 nt, Artificial Sequence
  Description of Artificial Sequence: Synthetic iRNA agent targeting human EGLN2 oligonucleotide
ggaacccccacgaggugaa

SEQ ID NO: 1716 - RNA, 19 nt, Artificial Sequence
  Description of Artificial Sequence: Synthetic iRNA agent targeting human EGLN2 oligonucleotide
uucaccucguggggguucc

SEQ ID NO: 1717 - RNA, 19 nt, Artificial Sequence
  Description of Artificial Sequence: Synthetic iRNA agent targeting human EGLN2 oligonucleotide
acgaggugaagccagccua

SEQ ID NO: 1718 - RNA, 19 nt, Artificial Sequence
  Description of Artificial Sequence: Synthetic iRNA agent targeting human EGLN2 oligonucleotide
uaggcuggcuucaccucgu

SEQ ID NO: 1719 - RNA, 19 nt, Artificial Sequence
  Description of Artificial Sequence: Synthetic iRNA agent targeting human EGLN2 oligonucleotide
gugaagccagccuaugcca

SEQ ID NO: 1720 - RNA, 19 nt, Artificial Sequence
  Description of Artificial Sequence: Synthetic iRNA agent targeting human EGLN2 oligonucleotide
uggcauaggcuggcuucac

SEQ ID NO: 1721 - RNA, 19 nt, Artificial Sequence
  Description of Artificial Sequence: Synthetic iRNA agent targeting human EGLN2 oligonucleotide
ccagccuaugccaccaggu

SEQ ID NO: 1722 - RNA, 19 nt, Artificial Sequence
  Description of Artificial Sequence: Synthetic iRNA agent targeting human EGLN2 oligonucleotide
accugguggcauaggcugg

SEQ ID NO: 1723 - RNA, 19 nt, Artificial Sequence
  Description of Artificial Sequence: Synthetic iRNA agent targeting human EGLN2 oligonucleotide
uaugccaccagguacgcca

SEQ ID NO: 1724 - RNA, 19 nt, Artificial Sequence
  Description of Artificial Sequence: Synthetic iRNA agent targeting human EGLN2 oligonucleotide
uggcguaccugguggcaua

SEQ ID NO: 1725 - RNA, 19 nt, Artificial Sequence
  Description of Artificial Sequence: Synthetic iRNA agent targeting human EGLN2 oligonucleotide
augccaccagguacgccau

SEQ ID NO: 1726 - RNA, 19 nt, Artificial Sequence
  Description of Artificial Sequence: Synthetic iRNA agent targeting human EGLN2 oligonucleotide
auggcguaccugguggcau

SEQ ID NO: 1727 - RNA, 19 nt, Artificial Sequence
  Description of Artificial Sequence: Synthetic iRNA agent targeting human EGLN2 oligonucleotide
ccagguacgccaucacugu

SEQ ID NO: 1728 - RNA, 19 nt, Artificial Sequence
  Description of Artificial Sequence: Synthetic iRNA agent targeting human EGLN2 oligonucleotide
acagugauggcguaccugg

SEQ ID NO: 1729 - RNA, 19 nt, Artificial Sequence
  Description of Artificial Sequence: Synthetic iRNA agent targeting human EGLN2 oligonucleotide
agguacgccaucacugucu

SEQ ID NO: 1730 - RNA, 19 nt, Artificial Sequence
  Description of Artificial Sequence: Synthetic iRNA agent targeting human EGLN2 oligonucleotide
agacagugauggcguaccu

SEQ ID NO: 1731 - RNA, 19 nt, Artificial Sequence
  Description of Artificial Sequence: Synthetic iRNA agent targeting human EGLN2 oligonucleotide
cgccaucacugucugguau

SEQ ID NO: 1732 - RNA, 19 nt, Artificial Sequence
  Description of Artificial Sequence: Synthetic iRNA agent targeting human EGLN2 oligonucleotide
auaccagacagugauggcg

SEQ ID NO: 1733 - RNA, 19 nt, Artificial Sequence
  Description of Artificial Sequence: Synthetic iRNA agent targeting human EGLN2 oligonucleotide
ccaucacugucugguauuu

SEQ ID NO: 1734 - RNA, 19 nt, Artificial Sequence
  Description of Artificial Sequence: Synthetic iRNA agent targeting human EGLN2 oligonucleotide
aaauaccagacagugaugg

SEQ ID NO: 1735 - RNA, 19 nt, Artificial Sequence
  Description of Artificial Sequence: Synthetic iRNA agent targeting human EGLN2 oligonucleotide
gcagcagccaaagacaagu

SEQ ID NO: 1736 - RNA, 19 nt, Artificial Sequence
  Description of Artificial Sequence: Synthetic iRNA agent targeting human EGLN2 oligonucleotide
acuugucuuuggcugcugc

SEQ ID NO: 1737 - RNA, 19 nt, Artificial Sequence
  Description of Artificial Sequence: Synthetic iRNA agent targeting human EGLN2 oligonucleotide
agcagccaaagacaaguau

SEQ ID NO: 1738 - RNA, 19 nt, Artificial Sequence
  Description of Artificial Sequence: Synthetic iRNA agent targeting human EGLN2 oligonucleotide
auacuugucuuuggcugcu

SEQ ID NO: 1739 - RNA, 19 nt, Artificial Sequence
  Description of Artificial Sequence: Synthetic iRNA agent targeting human EGLN2 oligonucleotide
cagccaaagacaaguauca

SEQ ID NO: 1740 - RNA, 19 nt, Artificial Sequence
  Description of Artificial Sequence: Synthetic iRNA agent targeting human EGLN2 oligonucleotide
ugauacuugucuuuggcug

SEQ ID NO: 1741 - RNA, 19 nt, Artificial Sequence
  Description of Artificial Sequence: Synthetic iRNA agent targeting human EGLN2 oligonucleotide
caaagacaaguaucagcua

SEQ ID NO: 1742 - RNA, 19 nt, Artificial Sequence
  Description of Artificial Sequence: Synthetic iRNA agent targeting human EGLN2 oligonucleotide
uagcugauacuugucuuug

SEQ ID NO: 1743 - RNA, 19 nt, Artificial Sequence
  Description of Artificial Sequence: Synthetic iRNA agent targeting human EGLN2 oligonucleotide
agacaaguaucagcuagca

SEQ ID NO: 1744 - RNA, 19 nt, Artificial Sequence
  Description of Artificial Sequence: Synthetic iRNA agent targeting human EGLN2 oligonucleotide
ugcuagcugauacuugucu

SEQ ID NO: 1745 - RNA, 19 nt, Artificial Sequence
  Description of Artificial Sequence: Synthetic iRNA agent targeting human EGLN2 oligonucleotide
gacaaguaucagcuagcau

SEQ ID NO: 1746 - RNA, 19 nt, Artificial Sequence
  Description of Artificial Sequence: Synthetic iRNA agent targeting human EGLN2 oligonucleotide
augcuagcugauacuuguc

SEQ ID NO: 1747 - RNA, 19 nt, Artificial Sequence
  Description of Artificial Sequence: Synthetic iRNA agent targeting human EGLN2 oligonucleotide
caaguaucagcuagcauca

SEQ ID NO: 1748 - RNA, 19 nt, Artificial Sequence
  Description of Artificial Sequence: Synthetic iRNA agent targeting human EGLN2 oligonucleotide
ugaugcuagcugauacuug

SEQ ID NO: 1749 - RNA, 19 nt, Artificial Sequence
  Description of Artificial Sequence: Synthetic iRNA agent targeting human EGLN2 oligonucleotide
guaucagcuagcaucagga

SEQ ID NO: 1750 - RNA, 19 nt, Artificial Sequence
  Description of Artificial Sequence: Synthetic iRNA agent targeting human EGLN2 oligonucleotide
uccugaugcuagcugauac

SEQ ID NO: 1751 - RNA, 19 nt, Artificial Sequence
  Description of Artificial Sequence: Synthetic iRNA agent targeting human EGLN2 oligonucleotide
aucagcuagcaucaggaca

SEQ ID NO: 1752 - RNA, 19 nt, Artificial Sequence
  Description of Artificial Sequence: Synthetic iRNA agent targeting human EGLN2 oligonucleotide
uguccugaugcuagcugau

SEQ ID NO: 1753 - RNA, 19 nt, Artificial Sequence
  Description of Artificial Sequence: Synthetic iRNA agent targeting human EGLN2 oligonucleotide
cagcuagcaucaggacaga

SEQ ID NO: 1754 - RNA, 19 nt, Artificial Sequence
  Description of Artificial Sequence: Synthetic iRNA agent targeting human EGLN2 oligonucleotide
ucuguccugaugcuagcug

SEQ ID NO: 1755 - RNA, 19 nt, Artificial Sequence
  Description of Artificial Sequence: Synthetic iRNA agent targeting human EGLN2 oligonucleotide
gcuagcaucaggacagaaa

SEQ ID NO: 1756 - RNA, 19 nt, Artificial Sequence
  Description of Artificial Sequence: Synthetic iRNA agent targeting human EGLN2 oligonucleotide
uuucuguccugaugcuagc

SEQ ID NO: 1757 - RNA, 19 nt, Artificial Sequence
  Description of Artificial Sequence: Synthetic iRNA agent targeting human EGLN2 oligonucleotide
gaaagguguccaaguaccu

SEQ ID NO: 1758 - RNA, 19 nt, Artificial Sequence
  Description of Artificial Sequence: Synthetic iRNA agent targeting human EGLN2 oligonucleotide
agguacuuggacaccuuuc

SEQ ID NO: 1759 - RNA, 19 nt, Artificial Sequence
  Description of Artificial Sequence: Synthetic iRNA agent targeting human EGLN2 oligonucleotide
uguccaaguaccuguauca

SEQ ID NO: 1760 - RNA, 19 nt, Artificial Sequence
  Description of Artificial Sequence: Synthetic iRNA agent targeting human EGLN2 oligonucleotide
ugauacagguacuuggaca

SEQ ID NO: 1761 - RNA, 19 nt, Artificial Sequence
  Description of Artificial Sequence: Synthetic iRNA agent targeting human EGLN2 oligonucleotide
ccgccuacgcccaccuagu

SEQ ID NO: 1762 - RNA, 19 nt, Artificial Sequence
  Description of Artificial Sequence: Synthetic iRNA agent targeting human EGLN2 oligonucleotide
acuaggugggcguaggcgg

SEQ ID NO: 1763 - RNA, 19 nt, Artificial Sequence
  Description of Artificial Sequence: Synthetic iRNA agent targeting human EGLN2 oligonucleotide
uacgcccaccuaguggcca

SEQ ID NO: 1764 - RNA, 19 nt, Artificial Sequence
  Description of Artificial Sequence: Synthetic iRNA agent targeting human EGLN2 oligonucleotide
uggccacuaggugggcgua

SEQ ID NO: 1765 - RNA, 19 nt, Artificial Sequence
  Description of Artificial Sequence: Synthetic iRNA agent targeting human EGLN2 oligonucleotide
ccuaguggccagucccaga

SEQ ID NO: 1766 - RNA, 19 nt, Artificial Sequence
  Description of Artificial Sequence: Synthetic iRNA agent targeting human EGLN2 oligonucleotide
ucugggacuggccacuagg

SEQ ID NO: 1767 - RNA, 19 nt, Artificial Sequence
  Description of Artificial Sequence: Synthetic iRNA agent targeting human EGLN2 oligonucleotide
cgcauggcagacagcuuaa

SEQ ID NO: 1768 - RNA, 19 nt, Artificial Sequence
  Description of Artificial Sequence: Synthetic iRNA agent targeting human EGLN2 oligonucleotide
uuaagcugucugccaugcg

SEQ ID NO: 1769 - RNA, 19 nt, Artificial Sequence
  Description of Artificial Sequence: Synthetic iRNA agent targeting human EGLN2 oligonucleotide
gcauggcagacagcuuaaa

SEQ ID NO: 1770 - RNA, 19 nt, Artificial Sequence
  Description of Artificial Sequence: Synthetic iRNA agent targeting human EGLN2 oligonucleotide
uuuaagcugucugccaugc

SEQ ID NO: 1771 - RNA, 19 nt, Artificial Sequence
  Description of Artificial Sequence: Synthetic iRNA agent targeting human EGLN2 oligonucleotide
uggcagacagcuuaaauga

SEQ ID NO: 1772 - RNA, 19 nt, Artificial Sequence
  Description of Artificial Sequence: Synthetic iRNA agent targeting human EGLN2 oligonucleotide
ucauuuaagcugucugcca

SEQ ID NO: 1773 - RNA, 19 nt, Artificial Sequence
  Description of Artificial Sequence: Synthetic iRNA agent targeting human EGLN2 oligonucleotide
gcagacagcuuaaaugacu

SEQ ID NO: 1774 - RNA, 19 nt, Artificial Sequence
  Description of Artificial Sequence: Synthetic iRNA agent targeting human EGLN2 oligonucleotide
agucauuuaagcugucugc

SEQ ID NO: 1775 - RNA, 19 nt, Artificial Sequence
  Description of Artificial Sequence: Synthetic iRNA agent targeting human EGLN2 oligonucleotide
aggaggagaagagaccuuu

SEQ ID NO: 1776 - RNA, 19 nt, Artificial Sequence
  Description of Artificial Sequence: Synthetic iRNA agent targeting human EGLN2 oligonucleotide
aaaggucucuucuccuccu

SEQ ID NO: 1777 - RNA, 19 nt, Artificial Sequence
  Description of Artificial Sequence: Synthetic iRNA agent targeting human EGLN2 oligonucleotide
gagaccuuugcugccccau

SEQ ID NO: 1778 - RNA, 19 nt, Artificial Sequence
  Description of Artificial Sequence: Synthetic iRNA agent targeting human EGLN2 oligonucleotide
auggggcagcaaaggucuc

SEQ ID NO: 1779 - RNA, 19 nt, Artificial Sequence
  Description of Artificial Sequence: Synthetic iRNA agent targeting human EGLN2 oligonucleotide
ucaugggggcugggguugu

SEQ ID NO: 1780 - RNA, 19 nt, Artificial Sequence
  Description of Artificial Sequence: Synthetic iRNA agent targeting human EGLN2 oligonucleotide
acaaccccagcccccauga

SEQ ID NO: 1781 - RNA, 19 nt, Artificial Sequence
  Description of Artificial Sequence: Synthetic iRNA agent targeting human EGLN2 oligonucleotide
guggaggccaccguuacca

SEQ ID NO: 1782 - RNA, 19 nt, Artificial Sequence
  Description of Artificial Sequence: Synthetic iRNA agent targeting human EGLN2 oligonucleotide
ugguaacgguggccuccac

SEQ ID NO: 1783 - RNA, 19 nt, Artificial Sequence
  Description of Artificial Sequence: Synthetic iRNA agent targeting human EGLN2 oligonucleotide
uggaggccaccguuaccaa

SEQ ID NO: 1784 - RNA, 19 nt, Artificial Sequence
  Description of Artificial Sequence: Synthetic iRNA agent targeting human EGLN2 oligonucleotide
uugguaacgguggccucca

SEQ ID NO: 1785 - RNA, 19 nt, Artificial Sequence
  Description of Artificial Sequence: Synthetic iRNA agent targeting human EGLN2 oligonucleotide
gaggccaccguuaccaacu

SEQ ID NO: 1786 - RNA, 19 nt, Artificial Sequence
  Description of Artificial Sequence: Synthetic iRNA agent targeting human EGLN2 oligonucleotide
aguugguaacgguggccuc

SEQ ID NO: 1787 - RNA, 19 nt, Artificial Sequence
  Description of Artificial Sequence: Synthetic iRNA agent targeting human EGLN2 oligonucleotide
ggccaccguuaccaacuga

SEQ ID NO: 1788 - RNA, 19 nt, Artificial Sequence
  Description of Artificial Sequence: Synthetic iRNA agent targeting human EGLN2 oligonucleotide
ucaguugguaacgguggcc

SEQ ID NO: 1789 - RNA, 19 nt, Artificial Sequence
  Description of Artificial Sequence: Synthetic iRNA agent targeting human EGLN2 oligonucleotide
ccuggguccuacccugucu

SEQ ID NO: 1790 - RNA, 19 nt, Artificial Sequence
  Description of Artificial Sequence: Synthetic iRNA agent targeting human EGLN2 oligonucleotide
agacaggguaggacccagg

SEQ ID NO: 1791 - RNA, 19 nt, Artificial Sequence
  Description of Artificial Sequence: Synthetic iRNA agent targeting human EGLN2 oligonucleotide
guccuacccugucugguca

SEQ ID NO: 1792 - RNA, 19 nt, Artificial Sequence
  Description of Artificial Sequence: Synthetic iRNA agent targeting human EGLN2 oligonucleotide
ugaccagacaggguaggac

SEQ ID NO: 1793 - RNA, 19 nt, Artificial Sequence
  Description of Artificial Sequence: Synthetic iRNA agent targeting human EGLN2 oligonucleotide
cuacccugucuggucauga

SEQ ID NO: 1794 - RNA, 19 nt, Artificial Sequence
  Description of Artificial Sequence: Synthetic iRNA agent targeting human EGLN2 oligonucleotide
ucaugaccagacaggguag

SEQ ID NO: 1795 - RNA, 19 nt, Artificial Sequence
  Description of Artificial Sequence: Synthetic iRNA agent targeting human EGLN2 oligonucleotide
cugucuggucaugacccca

SEQ ID NO: 1796 - RNA, 19 nt, Artificial Sequence
  Description of Artificial Sequence: Synthetic iRNA agent targeting human EGLN2 oligonucleotide
uggggucaugaccagacag

SEQ ID NO: 1797 - RNA, 19 nt, Artificial Sequence
  Description of Artificial Sequence: Synthetic iRNA agent targeting human EGLN2 oligonucleotide
ugucuggucaugaccccau

SEQ ID NO: 1798 - RNA, 19 nt, Artificial Sequence
  Description of Artificial Sequence: Synthetic iRNA agent targeting human EGLN2 oligonucleotide
auggggucaugaccagaca

SEQ ID NO: 1799 - RNA, 19 nt, Artificial Sequence
  Description of Artificial Sequence: Synthetic iRNA agent targeting human EGLN2 oligonucleotide
gucuggucaugaccccauu

SEQ ID NO: 1800 - RNA, 19 nt, Artificial Sequence
  Description of Artificial Sequence: Synthetic iRNA agent targeting human EGLN2 oligonucleotide
aauggggucaugaccagac

SEQ ID NO: 1801 - RNA, 19 nt, Artificial Sequence
  Description of Artificial Sequence: Synthetic iRNA agent targeting human EGLN2 oligonucleotide
ugaccccauuagguaugga

SEQ ID NO: 1802 - RNA, 19 nt, Artificial Sequence
  Description of Artificial Sequence: Synthetic iRNA agent targeting human EGLN2 oligonucleotide
uccauaccuaaugggguca

SEQ ID NO: 1803 - RNA, 19 nt, Artificial Sequence
  Description of Artificial Sequence: Synthetic iRNA agent targeting human EGLN2 oligonucleotide
accccauuagguauggaga

SEQ ID NO: 1804 - RNA, 19 nt, Artificial Sequence
  Description of Artificial Sequence: Synthetic iRNA agent targeting human EGLN2 oligonucleotide
ucuccauaccuaauggggu

SEQ ID NO: 1805 - RNA, 19 nt, Artificial Sequence
  Description of Artificial Sequence: Synthetic iRNA agent targeting human EGLN2 oligonucleotide
uagguauggagagcuggga

SEQ ID NO: 1806 - RNA, 19 nt, Artificial Sequence
  Description of Artificial Sequence: Synthetic iRNA agent targeting human EGLN2 oligonucleotide
ucccagcucuccauaccua

SEQ ID NO: 1807 - RNA, 19 nt, Artificial Sequence
  Description of Artificial Sequence: Synthetic iRNA agent targeting human EGLN2 oligonucleotide
cugggaggaggcauuguca

SEQ ID NO: 1808 - RNA, 19 nt, Artificial Sequence
  Description of Artificial Sequence: Synthetic iRNA agent targeting human EGLN2 oligonucleotide
ugacaaugccuccucccag

SEQ ID NO: 1809 - RNA, 19 nt, Artificial Sequence
  Description of Artificial Sequence: Synthetic iRNA agent targeting human EGLN2 oligonucleotide
ggaggaggcauugucacuu

SEQ ID NO: 1810 - RNA, 19 nt, Artificial Sequence
  Description of Artificial Sequence: Synthetic iRNA agent targeting human EGLN2 oligonucleotide
aagugacaaugccuccucc

SEQ ID NO: 1811 - RNA, 19 nt, Artificial Sequence
  Description of Artificial Sequence: Synthetic iRNA agent targeting human EGLN2 oligonucleotide
gaggcauugucacuuccca

SEQ ID NO: 1812 - RNA, 19 nt, Artificial Sequence
  Description of Artificial Sequence: Synthetic iRNA agent targeting human EGLN2 oligonucleotide
ugggaagugacaaugccuc

SEQ ID NO: 1813 - RNA, 19 nt, Artificial Sequence
  Description of Artificial Sequence: Synthetic iRNA agent targeting human EGLN2 oligonucleotide
gcauugucacuucccacca

SEQ ID NO: 1814 - RNA, 19 nt, Artificial Sequence
  Description of Artificial Sequence: Synthetic iRNA agent targeting human EGLN2 oligonucleotide
uggugggaagugacaaugc

SEQ ID NO: 1815 - RNA, 19 nt, Artificial Sequence
  Description of Artificial Sequence: Synthetic iRNA agent targeting human EGLN2 oligonucleotide
ggacuugggguugagguga

SEQ ID NO: 1816 - RNA, 19 nt, Artificial Sequence
  Description of Artificial Sequence: Synthetic iRNA agent targeting human EGLN2 oligonucleotide
ucaccucaaccccaagucc

SEQ ID NO: 1817 - RNA, 19 nt, Artificial Sequence
  Description of Artificial Sequence: Synthetic iRNA agent targeting human EGLN2 oligonucleotide
acuugggguugaggugagu

SEQ ID NO: 1818 - RNA, 19 nt, Artificial Sequence
  Description of Artificial Sequence: Synthetic iRNA agent targeting human EGLN2 oligonucleotide
acucaccucaaccccaagu

SEQ ID NO: 1819 - RNA, 19 nt, Artificial Sequence
  Description of Artificial Sequence: Synthetic iRNA agent targeting human EGLN2 oligonucleotide
ugggguugaggugagucau

SEQ ID NO: 1820 - RNA, 19 nt, Artificial Sequence
  Description of Artificial Sequence: Synthetic iRNA agent targeting human EGLN2 oligonucleotide
augacucaccucaacccca

SEQ ID NO: 1821 - RNA, 19 nt, Artificial Sequence
  Description of Artificial Sequence: Synthetic iRNA agent targeting human EGLN2 oligonucleotide
uugaggugagucauggccu

SEQ ID NO: 1822 - RNA, 19 nt, Artificial Sequence
  Description of Artificial Sequence: Synthetic iRNA agent targeting human EGLN2 oligonucleotide
aggccaugacucaccucaa

SEQ ID NO: 1823 - RNA, 19 nt, Artificial Sequence
  Description of Artificial Sequence: Synthetic iRNA agent targeting human EGLN2 oligonucleotide
gaggugagucauggccucu

SEQ ID NO: 1824 - RNA, 19 nt, Artificial Sequence
  Description of Artificial Sequence: Synthetic iRNA agent targeting human EGLN2 oligonucleotide
agaggccaugacucaccuc

SEQ ID NO: 1825 - RNA, 19 nt, Artificial Sequence
  Description of Artificial Sequence: Synthetic iRNA agent targeting human EGLN2 oligonucleotide
ugagucauggccucuugcu

SEQ ID NO: 1826 - RNA, 19 nt, Artificial Sequence
  Description of Artificial Sequence: Synthetic iRNA agent targeting human EGLN2 oligonucleotide
agcaagaggccaugacuca

SEQ ID NO: 1827 - RNA, 19 nt, Artificial Sequence
  Description of Artificial Sequence: Synthetic iRNA agent targeting human EGLN2 oligonucleotide
ucauggccucuugcuggca

SEQ ID NO: 1828 - RNA, 19 nt, Artificial Sequence
  Description of Artificial Sequence: Synthetic iRNA agent targeting human EGLN2 oligonucleotide
ugccagcaagaggccauga

SEQ ID NO: 1829 - RNA, 19 nt, Artificial Sequence
  Description of Artificial Sequence: Synthetic iRNA agent targeting human EGLN2 oligonucleotide
auggccucuugcuggcaau

SEQ ID NO: 1830 - RNA, 19 nt, Artificial Sequence
  Description of Artificial Sequence: Synthetic iRNA agent targeting human EGLN2 oligonucleotide
auugccagcaagaggccau

SEQ ID NO: 1831 - RNA, 19 nt, Artificial Sequence
  Description of Artificial Sequence: Synthetic iRNA agent targeting human EGLN2 oligonucleotide
cucuugcuggcaauggggu

SEQ ID NO: 1832 - RNA, 19 nt, Artificial Sequence
  Description of Artificial Sequence: Synthetic iRNA agent targeting human EGLN2 oligonucleotide
accccauugccagcaagag

SEQ ID NO: 1833 - RNA, 19 nt, Artificial Sequence
  Description of Artificial Sequence: Synthetic iRNA agent targeting human EGLN2 oligonucleotide
caauggggugggaggagua

SEQ ID NO: 1834 - RNA, 19 nt, Artificial Sequence
  Description of Artificial Sequence: Synthetic iRNA agent targeting human EGLN2 oligonucleotide
uacuccucccaccccauug

SEQ ID NO: 1835 - RNA, 19 nt, Artificial Sequence
  Description of Artificial Sequence: Synthetic iRNA agent targeting human EGLN2 oligonucleotide
gggaggaguacccccaagu

SEQ ID NO: 1836 - RNA, 19 nt, Artificial Sequence
  Description of Artificial Sequence: Synthetic iRNA agent targeting human EGLN2 oligonucleotide
acuuggggguacuccuccc

SEQ ID NO: 1837 - RNA, 19 nt, Artificial Sequence
  Description of Artificial Sequence: Synthetic iRNA agent targeting human EGLN2 oligonucleotide
aggaguacccccaaguccu

SEQ ID NO: 1838 - RNA, 19 nt, Artificial Sequence
  Description of Artificial Sequence: Synthetic iRNA agent targeting human EGLN2 oligonucleotide
aggacuuggggguacuccu

SEQ ID NO: 1839 - RNA, 19 nt, Artificial Sequence
  Description of Artificial Sequence: Synthetic iRNA agent targeting human EGLN2 oligonucleotide
cuccagccuggaaugugaa

SEQ ID NO: 1840 - RNA, 19 nt, Artificial Sequence
  Description of Artificial Sequence: Synthetic iRNA agent targeting human EGLN2 oligonucleotide
uucacauuccaggcuggag

SEQ ID NO: 1841 - RNA, 19 nt, Artificial Sequence
  Description of Artificial Sequence: Synthetic iRNA agent targeting human EGLN2 oligonucleotide
ccagccuggaaugugaagu

SEQ ID NO: 1842 - RNA, 19 nt, Artificial Sequence
  Description of Artificial Sequence: Synthetic iRNA agent targeting human EGLN2 oligonucleotide
acuucacauuccaggcugg

SEQ ID NO: 1843 - RNA, 19 nt, Artificial Sequence
  Description of Artificial Sequence: Synthetic iRNA agent targeting human EGLN2 oligonucleotide
aaugugaagugacucccca

SEQ ID NO: 1844 - RNA, 19 nt, Artificial Sequence
  Description of Artificial Sequence: Synthetic iRNA agent targeting human EGLN2 oligonucleotide
uggggagucacuucacauu

SEQ ID NO: 1845 - RNA, 19 nt, Artificial Sequence
  Description of Artificial Sequence: Synthetic iRNA agent targeting human EGLN2 oligonucleotide
ccuuuggccauggcaggca

SEQ ID NO: 1846 - RNA, 19 nt, Artificial Sequence
  Description of Artificial Sequence: Synthetic iRNA agent targeting human EGLN2 oligonucleotide
ugccugccauggccaaagg

SEQ ID NO: 1847 - RNA, 19 nt, Artificial Sequence
  Description of Artificial Sequence: Synthetic iRNA agent targeting human EGLN2 oligonucleotide
auggcaggcaccuuuugga

SEQ ID NO: 1848 - RNA, 19 nt, Artificial Sequence
  Description of Artificial Sequence: Synthetic iRNA agent targeting human EGLN2 oligonucleotide
uccaaaaggugccugccau

SEQ ID NO: 1849 - RNA, 19 nt, Artificial Sequence
  Description of Artificial Sequence: Synthetic iRNA agent targeting human EGLN2 oligonucleotide
gcaccuuuuggacugggcu

SEQ ID NO: 1850 - RNA, 19 nt, Artificial Sequence
  Description of Artificial Sequence: Synthetic iRNA agent targeting human EGLN2 oligonucleotide
agcccaguccaaaaggugc

SEQ ID NO: 1851 - RNA, 19 nt, Artificial Sequence
  Description of Artificial Sequence: Synthetic iRNA agent targeting human EGLN2 oligonucleotide
cacugcuugggcagaguaa

SEQ ID NO: 1852 - RNA, 19 nt, Artificial Sequence
  Description of Artificial Sequence: Synthetic iRNA agent targeting human EGLN2 oligonucleotide
uuacucugcccaagcagug

SEQ ID NO: 1853 - RNA, 19 nt, Artificial Sequence
  Description of Artificial Sequence: Synthetic iRNA agent targeting human EGLN2 oligonucleotide
acugcuugggcagaguaaa

SEQ ID NO: 1854 - RNA, 19 nt, Artificial Sequence
  Description of Artificial Sequence: Synthetic iRNA agent targeting human EGLN2 oligonucleotide
uuuacucugcccaagcagu

SEQ ID NO: 1855 - RNA, 19 nt, Artificial Sequence
  Description of Artificial Sequence: Synthetic iRNA agent targeting human EGLN2 oligonucleotide
cugcuugggcagaguaaaa

SEQ ID NO: 1856 - RNA, 19 nt, Artificial Sequence
  Description of Artificial Sequence: Synthetic iRNA agent targeting human EGLN2 oligonucleotide
uuuuacucugcccaagcag

SEQ ID NO: 1857 - RNA, 19 nt, Artificial Sequence
  Description of Artificial Sequence: Synthetic iRNA agent targeting human EGLN2 oligonucleotide
cuugggcagaguaaaaggu

SEQ ID NO: 1858 - RNA, 19 nt, Artificial Sequence
  Description of Artificial Sequence: Synthetic iRNA agent targeting human EGLN2 oligonucleotide
accuuuuacucugcccaag

SEQ ID NO: 1859 - RNA, 19 nt, Artificial Sequence
  Description of Artificial Sequence: Synthetic iRNA agent targeting human EGLN2 oligonucleotide
ggcagaguaaaaggugcca

SEQ ID NO: 1860 - RNA, 19 nt, Artificial Sequence
  Description of Artificial Sequence: Synthetic iRNA agent targeting human EGLN2 oligonucleotide
uggcaccuuuuacucugcc

SEQ ID NO: 1861 - RNA, 19 nt, Artificial Sequence
  Description of Artificial Sequence: Synthetic iRNA agent targeting human EGLN2 oligonucleotide
ccucagagcugcaaaaaaa

SEQ ID NO: 1862 - RNA, 19 nt, Artificial Sequence
  Description of Artificial Sequence: Synthetic iRNA agent targeting human EGLN2 oligonucleotide
uuuuuuugcagcucugagg

SEQ ID NO: 1863 - RNA, 19 nt, Artificial Sequence
  Description of Artificial Sequence: Synthetic iRNA agent targeting human EGLN3 oligonucleotide
uggccgcagucgcggcagu

SEQ ID NO: 1864 - RNA, 19 nt, Artificial Sequence
  Description of Artificial Sequence: Synthetic iRNA agent targeting human EGLN3 oligonucleotide
acugccgcgacugcggcca

SEQ ID NO: 1865 - RNA, 19 nt, Artificial Sequence
  Description of Artificial Sequence: Synthetic iRNA agent targeting human EGLN3 oligonucleotide
cauccccaaaaggcgcccu

SEQ ID NO: 1866 - RNA, 19 nt, Artificial Sequence
  Description of Artificial Sequence: Synthetic iRNA agent targeting human EGLN3 oligonucleotide
agggcgccuuuuggggaug

SEQ ID NO: 1867 - RNA, 19 nt, Artificial Sequence
  Description of Artificial Sequence: Synthetic iRNA agent targeting human EGLN3 oligonucleotide
caaaaggcgcccuccgacu

SEQ ID NO: 1868 - RNA, 19 nt, Artificial Sequence
  Description of Artificial Sequence: Synthetic iRNA agent targeting human EGLN3 oligonucleotide
agucggagggcgccuuuug

SEQ ID NO: 1869 - RNA, 19 nt, Artificial Sequence
  Description of Artificial Sequence: Synthetic iRNA agent targeting human EGLN3 oligonucleotide
uccgacuccuugcgccgca

SEQ ID NO: 1870 - RNA, 19 nt, Artificial Sequence
  Description of Artificial Sequence: Synthetic iRNA agent targeting human EGLN3 oligonucleotide
ugcggcgcaaggagucgga

SEQ ID NO: 1871 - RNA, 19 nt, Artificial Sequence
  Description of Artificial Sequence: Synthetic iRNA agent targeting human EGLN3 oligonucleotide
cuccuugcgccgcacugcu

SEQ ID NO: 1872 - RNA, 19 nt, Artificial Sequence
  Description of Artificial Sequence: Synthetic iRNA agent targeting human EGLN3 oligonucleotide
agcagugcggcgcaaggag

SEQ ID NO: 1873 - RNA, 19 nt, Artificial Sequence
  Description of Artificial Sequence: Synthetic iRNA agent targeting human EGLN3 oligonucleotide
cucgccgggccaguccgga

SEQ ID NO: 1874 - RNA, 19 nt, Artificial Sequence
  Description of Artificial Sequence: Synthetic iRNA agent targeting human EGLN3 oligonucleotide
uccggacuggcccggcgag

SEQ ID NO: 1875 - RNA, 19 nt, Artificial Sequence
  Description of Artificial Sequence: Synthetic iRNA agent targeting human EGLN3 oligonucleotide
ucgccgggccaguccggaa

SEQ ID NO: 1876 - RNA, 19 nt, Artificial Sequence
  Description of Artificial Sequence: Synthetic iRNA agent targeting human EGLN3 oligonucleotide
uuccggacuggcccggcga

SEQ ID NO: 1877 - RNA, 19 nt, Artificial Sequence
  Description of Artificial Sequence: Synthetic iRNA agent targeting human EGLN3 oligonucleotide
cgccgggccaguccggaaa

SEQ ID NO: 1878 - RNA, 19 nt, Artificial Sequence
  Description of Artificial Sequence: Synthetic iRNA agent targeting human EGLN3 oligonucleotide
uuuccggacuggcccggcg

SEQ ID NO: 1879 - RNA, 19 nt, Artificial Sequence
  Description of Artificial Sequence: Synthetic iRNA agent targeting human EGLN3 oligonucleotide
caguccggaaacgggucgu

SEQ ID NO: 1880 - RNA, 19 nt, Artificial Sequence
  Description of Artificial Sequence: Synthetic iRNA agent targeting human EGLN3 oligonucleotide
acgacccguuuccggacug

SEQ ID NO: 1881 - RNA, 19 nt, Artificial Sequence
  Description of Artificial Sequence: Synthetic iRNA agent targeting human EGLN3 oligonucleotide
uccggaaacgggucgugga

SEQ ID NO: 1882 - RNA, 19 nt, Artificial Sequence
  Description of Artificial Sequence: Synthetic iRNA agent targeting human EGLN3 oligonucleotide
uccacgacccguuuccgga

SEQ ID NO: 1883 - RNA, 19 nt, Artificial Sequence
  Description of Artificial Sequence: Synthetic iRNA agent targeting human EGLN3 oligonucleotide
gucguggagcuccgcacca

SEQ ID NO: 1884 - RNA, 19 nt, Artificial Sequence
  Description of Artificial Sequence: Synthetic iRNA agent targeting human EGLN3 oligonucleotide
uggugcggagcuccacgac

SEQ ID NO: 1885 - RNA, 19 nt, Artificial Sequence
  Description of Artificial Sequence: Synthetic iRNA agent targeting human EGLN3 oligonucleotide
cguggagcuccgcaccacu

SEQ ID NO: 1886 - RNA, 19 nt, Artificial Sequence
  Description of Artificial Sequence: Synthetic iRNA agent targeting human EGLN3 oligonucleotide
aguggugcggagcuccacg

SEQ ID NO: 1887 - RNA, 19 nt, Artificial Sequence
  Description of Artificial Sequence: Synthetic iRNA agent targeting human EGLN3 oligonucleotide
gcuccgcaccacucccgcu

SEQ ID NO: 1888 - RNA, 19 nt, Artificial Sequence
  Description of Artificial Sequence: Synthetic iRNA agent targeting human EGLN3 oligonucleotide
agcgggaguggugcggagc

SEQ ID NO: 1889 - RNA, 19 nt, Artificial Sequence
  Description of Artificial Sequence: Synthetic iRNA agent targeting human EGLN3 oligonucleotide
cgcaccacucccgcugguu

SEQ ID NO: 1890 - RNA, 19 nt, Artificial Sequence
  Description of Artificial Sequence: Synthetic iRNA agent targeting human EGLN3 oligonucleotide
aaccagcgggaguggugcg

SEQ ID NO: 1891 - RNA, 19 nt, Artificial Sequence
  Description of Artificial Sequence: Synthetic iRNA agent targeting human EGLN3 oligonucleotide
gcugguucccgaaggcaga

SEQ ID NO: 1892 - RNA, 19 nt, Artificial Sequence
  Description of Artificial Sequence: Synthetic iRNA agent targeting human EGLN3 oligonucleotide
ucugccuucgggaaccagc

SEQ ID NO: 1893 - RNA, 19 nt, Artificial Sequence
  Description of Artificial Sequence: Synthetic iRNA agent targeting human EGLN3 oligonucleotide
ucccgaaggcagaucccuu

SEQ ID NO: 1894 - RNA, 19 nt, Artificial Sequence
  Description of Artificial Sequence: Synthetic iRNA agent targeting human EGLN3 oligonucleotide
aagggaucugccuucggga

SEQ ID NO: 1895 - RNA, 19 nt, Artificial Sequence
  Description of Artificial Sequence: Synthetic iRNA agent targeting human EGLN3 oligonucleotide
cagaucccuucucccgaga

SEQ ID NO: 1896 - RNA, 19 nt, Artificial Sequence
  Description of Artificial Sequence: Synthetic iRNA agent targeting human EGLN3 oligonucleotide
ucucgggagaagggaucug

SEQ ID NO: 1897 - RNA, 19 nt, Artificial Sequence
  Description of Artificial Sequence: Synthetic iRNA agent targeting human EGLN3 oligonucleotide
gaucccuucucccgagagu

SEQ ID NO: 1898 - RNA, 19 nt, Artificial Sequence
  Description of Artificial Sequence: Synthetic iRNA agent targeting human EGLN3 oligonucleotide
acucucgggagaagggauc

SEQ ID NO: 1899 - RNA, 19 nt, Artificial Sequence
  Description of Artificial Sequence: Synthetic iRNA agent targeting human EGLN3 oligonucleotide
aucccuucucccgagaguu

SEQ ID NO: 1900 - RNA, 19 nt, Artificial Sequence
  Description of Artificial Sequence: Synthetic iRNA agent targeting human EGLN3 oligonucleotide
aacucucgggagaagggau

SEQ ID NO: 1901 - RNA, 19 nt, Artificial Sequence
  Description of Artificial Sequence: Synthetic iRNA agent targeting human EGLN3 oligonucleotide
cuucucccgagaguugcga

SEQ ID NO: 1902 - RNA, 19 nt, Artificial Sequence
  Description of Artificial Sequence: Synthetic iRNA agent targeting human EGLN3 oligonucleotide
ucgcaacucucgggagaag

SEQ ID NO: 1903 - RNA, 19 nt, Artificial Sequence
  Description of Artificial Sequence: Synthetic iRNA agent targeting human EGLN3 oligonucleotide
ucucccgagaguugcgaga

SEQ ID NO: 1904 - RNA, 19 nt, Artificial Sequence
  Description of Artificial Sequence: Synthetic iRNA agent targeting human EGLN3 oligonucleotide
ucucgcaacucucgggaga

SEQ ID NO: 1905 - RNA, 19 nt, Artificial Sequence
  Description of Artificial Sequence: Synthetic iRNA agent targeting human EGLN3 oligonucleotide
cucccgagaguugcgagaa

SEQ ID NO: 1906 - RNA, 19 nt, Artificial Sequence
  Description of Artificial Sequence: Synthetic iRNA agent targeting human EGLN3 oligonucleotide
uucucgcaacucucgggag

SEQ ID NO: 1907 - RNA, 19 nt, Artificial Sequence
  Description of Artificial Sequence: Synthetic iRNA agent targeting human EGLN3 oligonucleotide
ucccgagaguugcgagaaa

SEQ ID NO: 1908 - RNA, 19 nt, Artificial Sequence
  Description of Artificial Sequence: Synthetic iRNA agent targeting human EGLN3 oligonucleotide
uuucucgcaacucucggga

SEQ ID NO: 1909 - RNA, 19 nt, Artificial Sequence
  Description of Artificial Sequence: Synthetic iRNA agent targeting human EGLN3 oligonucleotide
ccgagaguugcgagaaacu

SEQ ID NO: 1910 - RNA, 19 nt, Artificial Sequence
  Description of Artificial Sequence: Synthetic iRNA agent targeting human EGLN3 oligonucleotide
aguuucucgcaacucucgg

SEQ ID NO: 1911 - RNA, 19 nt, Artificial Sequence
  Description of Artificial Sequence: Synthetic iRNA agent targeting human EGLN3 oligonucleotide
cgagaguugcgagaaacuu

SEQ ID NO: 1912 - RNA, 19 nt, Artificial Sequence
  Description of Artificial Sequence: Synthetic iRNA agent targeting human EGLN3 oligonucleotide
aaguuucucgcaacucucg

SEQ ID NO: 1913 - RNA, 19 nt, Artificial Sequence
  Description of Artificial Sequence: Synthetic iRNA agent targeting human EGLN3 oligonucleotide
gagaguugcgagaaacuuu

SEQ ID NO: 1914 - RNA, 19 nt, Artificial Sequence
  Description of Artificial Sequence: Synthetic iRNA agent targeting human EGLN3 oligonucleotide
aaaguuucucgcaacucuc

SEQ ID NO: 1915 - RNA, 19 nt, Artificial Sequence
  Description of Artificial Sequence: Synthetic iRNA agent targeting human EGLN3 oligonucleotide
uugcgagaaacuuucccuu

SEQ ID NO: 1916 - RNA, 19 nt, Artificial Sequence
  Description of Artificial Sequence: Synthetic iRNA agent targeting human EGLN3 oligonucleotide
aagggaaaguuucucgcaa

SEQ ID NO: 1917 - RNA, 19 nt, Artificial Sequence
  Description of Artificial Sequence: Synthetic iRNA agent targeting human EGLN3 oligonucleotide
gcgagaaacuuucccuugu

SEQ ID NO: 1918 - RNA, 19 nt, Artificial Sequence
  Description of Artificial Sequence: Synthetic iRNA agent targeting human EGLN3 oligonucleotide
acaagggaaaguuucucgc

SEQ ID NO: 1919 - RNA, 19 nt, Artificial Sequence
  Description of Artificial Sequence: Synthetic iRNA agent targeting human EGLN3 oligonucleotide
gcagcggcucggguaccgu

SEQ ID NO: 1920 - RNA, 19 nt, Artificial Sequence
  Description of Artificial Sequence: Synthetic iRNA agent targeting human EGLN3 oligonucleotide
acgguacccgagccgcugc

SEQ ID NO: 1921 - RNA, 19 nt, Artificial Sequence
  Description of Artificial Sequence: Synthetic iRNA agent targeting human EGLN3 oligonucleotide
guggcagccgcagguuucu

SEQ ID NO: 1922 - RNA, 19 nt, Artificial Sequence
  Description of Artificial Sequence: Synthetic iRNA agent targeting human EGLN3 oligonucleotide
agaaaccugcggcugccac

SEQ ID NO: 1923 - RNA, 19 nt, Artificial Sequence
  Description of Artificial Sequence: Synthetic iRNA agent targeting human EGLN3 oligonucleotide
ggcagccgcagguuucuga

SEQ ID NO: 1924 - RNA, 19 nt, Artificial Sequence
  Description of Artificial Sequence: Synthetic iRNA agent targeting human EGLN3 oligonucleotide
ucagaaaccugcggcugcc

SEQ ID NO: 1925 - RNA, 19 nt, Artificial Sequence
  Description of Artificial Sequence: Synthetic iRNA agent targeting human EGLN3 oligonucleotide
gcagccgcagguuucugaa

SEQ ID NO: 1926 - RNA, 19 nt, Artificial Sequence
  Description of Artificial Sequence: Synthetic iRNA agent targeting human EGLN3 oligonucleotide
uucagaaaccugcggcugc

SEQ ID NO: 1927 - RNA, 19 nt, Artificial Sequence
  Description of Artificial Sequence: Synthetic iRNA agent targeting human EGLN3 oligonucleotide
cgcgccucggcuucgcgcu

SEQ ID NO: 1928 - RNA, 19 nt, Artificial Sequence
  Description of Artificial Sequence: Synthetic iRNA agent targeting human EGLN3 oligonucleotide
agcgcgaagccgaggcgcg

SEQ ID NO: 1929 - RNA, 19 nt, Artificial Sequence
  Description of Artificial Sequence: Synthetic iRNA agent targeting human EGLN3 oligonucleotide
cucggcuucgcgcucgugu

SEQ ID NO: 1930 - RNA, 19 nt, Artificial Sequence
  Description of Artificial Sequence: Synthetic iRNA agent targeting human EGLN3 oligonucleotide
acacgagcgcgaagccgag

SEQ ID NO: 1931 - RNA, 19 nt, Artificial Sequence
  Description of Artificial Sequence: Synthetic iRNA agent targeting human EGLN3 oligonucleotide
ucggcuucgcgcucgugua

SEQ ID NO: 1932 - RNA, 19 nt, Artificial Sequence
  Description of Artificial Sequence: Synthetic iRNA agent targeting human EGLN3 oligonucleotide
uacacgagcgcgaagccga

SEQ ID NO: 1933 - RNA, 19 nt, Artificial Sequence
  Description of Artificial Sequence: Synthetic iRNA agent targeting human EGLN3 oligonucleotide
ggcuucgcgcucguguaga

SEQ ID NO: 1934 - RNA, 19 nt, Artificial Sequence
  Description of Artificial Sequence: Synthetic iRNA agent targeting human EGLN3 oligonucleotide
ucuacacgagcgcgaagcc

SEQ ID NO: 1935 - RNA, 19 nt, Artificial Sequence
  Description of Artificial Sequence: Synthetic iRNA agent targeting human EGLN3 oligonucleotide
gcuucgcgcucguguagau

SEQ ID NO: 1936 - RNA, 19 nt, Artificial Sequence
  Description of Artificial Sequence: Synthetic iRNA agent targeting human EGLN3 oligonucleotide
aucuacacgagcgcgaagc

SEQ ID NO: 1937 - RNA, 19 nt, Artificial Sequence
  Description of Artificial Sequence: Synthetic iRNA agent targeting human EGLN3 oligonucleotide
ucgcgcucguguagaucgu

SEQ ID NO: 1938 - RNA, 19 nt, Artificial Sequence
  Description of Artificial Sequence: Synthetic iRNA agent targeting human EGLN3 oligonucleotide
acgaucuacacgagcgcga

SEQ ID NO: 1939 - RNA, 19 nt, Artificial Sequence
  Description of Artificial Sequence: Synthetic iRNA agent targeting human EGLN3 oligonucleotide
cgcgcucguguagaucguu

SEQ ID NO: 1940 - RNA, 19 nt, Artificial Sequence
  Description of Artificial Sequence: Synthetic iRNA agent targeting human EGLN3 oligonucleotide
aacgaucuacacgagcgcg

SEQ ID NO: 1941 - RNA, 19 nt, Artificial Sequence
  Description of Artificial Sequence: Synthetic iRNA agent targeting human EGLN3 oligonucleotide
cucguguagaucguucccu

SEQ ID NO: 1942 - RNA, 19 nt, Artificial Sequence
  Description of Artificial Sequence: Synthetic iRNA agent targeting human EGLN3 oligonucleotide
agggaacgaucuacacgag

SEQ ID NO: 1943 - RNA, 19 nt, Artificial Sequence
  Description of Artificial Sequence: Synthetic iRNA agent targeting human EGLN3 oligonucleotide
gaucguucccucucugguu

SEQ ID NO: 1944 - RNA, 19 nt, Artificial Sequence
  Description of Artificial Sequence: Synthetic iRNA agent targeting human EGLN3 oligonucleotide
aaccagagagggaacgauc

SEQ ID NO: 1945 - RNA, 19 nt, Artificial Sequence
  Description of Artificial Sequence: Synthetic iRNA agent targeting human EGLN3 oligonucleotide
cguucccucucugguugca

SEQ ID NO: 1946 - RNA, 19 nt, Artificial Sequence
  Description of Artificial Sequence: Synthetic iRNA agent targeting human EGLN3 oligonucleotide
ugcaaccagagagggaacg

SEQ ID NO: 1947 - RNA, 19 nt, Artificial Sequence
  Description of Artificial Sequence: Synthetic iRNA agent targeting human EGLN3 oligonucleotide
cccucucugguugcacgcu

SEQ ID NO: 1948 - RNA, 19 nt, Artificial Sequence
  Description of Artificial Sequence: Synthetic iRNA agent targeting human EGLN3 oligonucleotide
agcgugcaaccagagaggg

SEQ ID NO: 1949 - RNA, 19 nt, Artificial Sequence
  Description of Artificial Sequence: Synthetic iRNA agent targeting human EGLN3 oligonucleotide
ucugguugcacgcugggga

SEQ ID NO: 1950 - RNA, 19 nt, Artificial Sequence
  Description of Artificial Sequence: Synthetic iRNA agent targeting human EGLN3 oligonucleotide
uccccagcgugcaaccaga

SEQ ID NO: 1951 - RNA, 19 nt, Artificial Sequence
  Description of Artificial Sequence: Synthetic iRNA agent targeting human EGLN3 oligonucleotide
cugguugcacgcuggggau

SEQ ID NO: 1952 - RNA, 19 nt, Artificial Sequence
  Description of Artificial Sequence: Synthetic iRNA agent targeting human EGLN3 oligonucleotide
auccccagcgugcaaccag

SEQ ID NO: 1953 - RNA, 19 nt, Artificial Sequence
  Description of Artificial Sequence: Synthetic iRNA agent targeting human EGLN3 oligonucleotide
uggggaucccggaccucga

SEQ ID NO: 1954 - RNA, 19 nt, Artificial Sequence
  Description of Artificial Sequence: Synthetic iRNA agent targeting human EGLN3 oligonucleotide
ucgagguccgggaucccca

SEQ ID NO: 1955 - RNA, 19 nt, Artificial Sequence
  Description of Artificial Sequence: Synthetic iRNA agent targeting human EGLN3 oligonucleotide
ggggaucccggaccucgau

SEQ ID NO: 1956 - RNA, 19 nt, Artificial Sequence
  Description of Artificial Sequence: Synthetic iRNA agent targeting human EGLN3 oligonucleotide
aucgagguccgggaucccc

SEQ ID NO: 1957 - RNA, 19 nt, Artificial Sequence
  Description of Artificial Sequence: Synthetic iRNA agent targeting human EGLN3 oligonucleotide
gaucccggaccucgauucu

SEQ ID NO: 1958 - RNA, 19 nt, Artificial Sequence
  Description of Artificial Sequence: Synthetic iRNA agent targeting human EGLN3 oligonucleotide
agaaucgagguccgggauc

SEQ ID NO: 1959 - RNA, 19 nt, Artificial Sequence
  Description of Artificial Sequence: Synthetic iRNA agent targeting human EGLN3 oligonucleotide
accucgauucugcgggcga

SEQ ID NO: 1960 - RNA, 19 nt, Artificial Sequence
  Description of Artificial Sequence: Synthetic iRNA agent targeting human EGLN3 oligonucleotide
ucgcccgcagaaucgaggu

SEQ ID NO: 1961 - RNA, 19 nt, Artificial Sequence
  Description of Artificial Sequence: Synthetic iRNA agent targeting human EGLN3 oligonucleotide
cucgauucugcgggcgaga

SEQ ID NO: 1962 - RNA, 19 nt, Artificial Sequence
  Description of Artificial Sequence: Synthetic iRNA agent targeting human EGLN3 oligonucleotide
ucucgcccgcagaaucgag

SEQ ID NO: 1963 - RNA, 19 nt, Artificial Sequence
  Description of Artificial Sequence: Synthetic iRNA agent targeting human EGLN3 oligonucleotide
accuggagaaaauugcccu

SEQ ID NO: 1964 - RNA, 19 nt, Artificial Sequence
  Description of Artificial Sequence: Synthetic iRNA agent targeting human EGLN3 oligonucleotide
agggcaauuuucuccaggu

SEQ ID NO: 1965 - RNA, 19 nt, Artificial Sequence
  Description of Artificial Sequence: Synthetic iRNA agent targeting human EGLN3 oligonucleotide
uugcccuggaguacaucgu

SEQ ID NO: 1966 - RNA, 19 nt, Artificial Sequence
  Description of Artificial Sequence: Synthetic iRNA agent targeting human EGLN3 oligonucleotide
acgauguacuccagggcaa

SEQ ID NO: 1967 - RNA, 19 nt, Artificial Sequence
  Description of Artificial Sequence: Synthetic iRNA agent targeting human EGLN3 oligonucleotide
aguacaucgugcccugucu

SEQ ID NO: 1968 - RNA, 19 nt, Artificial Sequence
  Description of Artificial Sequence: Synthetic iRNA agent targeting human EGLN3 oligonucleotide
agacagggcacgauguacu

SEQ ID NO: 1969 - RNA, 19 nt, Artificial Sequence
  Description of Artificial Sequence: Synthetic iRNA agent targeting human EGLN3 oligonucleotide
ucgugcccugucugcacga

SEQ ID NO: 1970 - RNA, 19 nt, Artificial Sequence
  Description of Artificial Sequence: Synthetic iRNA agent targeting human EGLN3 oligonucleotide
ucgugcagacagggcacga

SEQ ID NO: 1971 - RNA, 19 nt, Artificial Sequence
  Description of Artificial Sequence: Synthetic iRNA agent targeting human EGLN3 oligonucleotide
ugucugcacgaggugggcu

SEQ ID NO: 1972 - RNA, 19 nt, Artificial Sequence
  Description of Artificial Sequence: Synthetic iRNA agent targeting human EGLN3 oligonucleotide
agcccaccucgugcagaca

SEQ ID NO: 1973 - RNA, 19 nt, Artificial Sequence
  Description of Artificial Sequence: Synthetic iRNA agent targeting human EGLN3 oligonucleotide
gcguccuggagcgcgucaa

SEQ ID NO: 1974 - RNA, 19 nt, Artificial Sequence
  Description of Artificial Sequence: Synthetic iRNA agent targeting human EGLN3 oligonucleotide
uugacgcgcuccaggacgc

SEQ ID NO: 1975 - RNA, 19 nt, Artificial Sequence
  Description of Artificial Sequence: Synthetic iRNA agent targeting human EGLN3 oligonucleotide
cgccggcgucuccaagcga

SEQ ID NO: 1976 - RNA, 19 nt, Artificial Sequence
  Description of Artificial Sequence: Synthetic iRNA agent targeting human EGLN3 oligonucleotide
ucgcuuggagacgccggcg

SEQ ID NO: 1977 - RNA, 19 nt, Artificial Sequence
  Description of Artificial Sequence: Synthetic iRNA agent targeting human EGLN3 oligonucleotide
gcgucuccaagcgacaccu

SEQ ID NO: 1978 - RNA, 19 nt, Artificial Sequence
  Description of Artificial Sequence: Synthetic iRNA agent targeting human EGLN3 oligonucleotide
aggugucgcuuggagacgc

SEQ ID NO: 1979 - RNA, 19 nt, Artificial Sequence
  Description of Artificial Sequence: Synthetic iRNA agent targeting human EGLN3 oligonucleotide
gacaccugcggggcgacca

SEQ ID NO: 1980 - RNA, 19 nt, Artificial Sequence
  Description of Artificial Sequence: Synthetic iRNA agent targeting human EGLN3 oligonucleotide
uggucgccccgcagguguc

SEQ ID NO: 1981 - RNA, 19 nt, Artificial Sequence
  Description of Artificial Sequence: Synthetic iRNA agent targeting human EGLN3 oligonucleotide
caccugcggggcgaccaga

SEQ ID NO: 1982 - RNA, 19 nt, Artificial Sequence
  Description of Artificial Sequence: Synthetic iRNA agent targeting human EGLN3 oligonucleotide
ucuggucgccccgcaggug

SEQ ID NO: 1983 - RNA, 19 nt, Artificial Sequence
  Description of Artificial Sequence: Synthetic iRNA agent targeting human EGLN3 oligonucleotide
ucacguggaucgggggcaa

SEQ ID NO: 1984 - RNA, 19 nt, Artificial Sequence
  Description of Artificial Sequence: Synthetic iRNA agent targeting human EGLN3 oligonucleotide
uugcccccgauccacguga

SEQ ID NO: 1985 - RNA, 19 nt, Artificial Sequence
  Description of Artificial Sequence: Synthetic iRNA agent targeting human EGLN3 oligonucleotide
ggaucgggggcaacgagga

SEQ ID NO: 1986 - RNA, 19 nt, Artificial Sequence
  Description of Artificial Sequence: Synthetic iRNA agent targeting human EGLN3 oligonucleotide
uccucguugcccccgaucc

SEQ ID NO: 1987 - RNA, 19 nt, Artificial Sequence
  Description of Artificial Sequence: Synthetic iRNA agent targeting human EGLN3 oligonucleotide
ucgacaggcugguccucua

SEQ ID NO: 1988 - RNA, 19 nt, Artificial Sequence
  Description of Artificial Sequence: Synthetic iRNA agent targeting human EGLN3 oligonucleotide
uagaggaccagccugucga

SEQ ID NO: 1989 - RNA, 19 nt, Artificial Sequence
  Description of Artificial Sequence: Synthetic iRNA agent targeting human EGLN3 oligonucleotide
gacaggcugguccucuacu

SEQ ID NO: 1990 - RNA, 19 nt, Artificial Sequence
  Description of Artificial Sequence: Synthetic iRNA agent targeting human EGLN3 oligonucleotide
aguagaggaccagccuguc

SEQ ID NO: 1991 - RNA, 19 nt, Artificial Sequence
  Description of Artificial Sequence: Synthetic iRNA agent targeting human EGLN3 oligonucleotide
cugguccucuacugcggga

SEQ ID NO: 1992 - RNA, 19 nt, Artificial Sequence
  Description of Artificial Sequence: Synthetic iRNA agent targeting human EGLN3 oligonucleotide
ucccgcaguagaggaccag

SEQ ID NO: 1993 - RNA, 19 nt, Artificial Sequence
  Description of Artificial Sequence: Synthetic iRNA agent targeting human EGLN3 oligonucleotide
ggagccggcugggcaaaua

SEQ ID NO: 1994 - RNA, 19 nt, Artificial Sequence
  Description of Artificial Sequence: Synthetic iRNA agent targeting human EGLN3 oligonucleotide
uauuugcccagccggcucc

SEQ ID NO: 1995 - RNA, 19 nt, Artificial Sequence
  Description of Artificial Sequence: Synthetic iRNA agent targeting human EGLN3 oligonucleotide
gccggcugggcaaauacua

SEQ ID NO: 1996 - RNA, 19 nt, Artificial Sequence
  Description of Artificial Sequence: Synthetic iRNA agent targeting human EGLN3 oligonucleotide
uaguauuugcccagccggc

SEQ ID NO: 1997 - RNA, 19 nt, Artificial Sequence
  Description of Artificial Sequence: Synthetic iRNA agent targeting human EGLN3 oligonucleotide
ggcugggcaaauacuacgu

SEQ ID NO: 1998 - RNA, 19 nt, Artificial Sequence
  Description of Artificial Sequence: Synthetic iRNA agent targeting human EGLN3 oligonucleotide
acguaguauuugcccagcc

SEQ ID NO: 1999 - RNA, 19 nt, Artificial Sequence
  Description of Artificial Sequence: Synthetic iRNA agent targeting human EGLN3 oligonucleotide
cugggcaaauacuacguca

SEQ ID NO: 2000 - RNA, 19 nt, Artificial Sequence
  Description of Artificial Sequence: Synthetic iRNA agent targeting human EGLN3 oligonucleotide
ugacguaguauuugcccag

SEQ ID NO: 2001 - RNA, 19 nt, Artificial Sequence
  Description of Artificial Sequence: Synthetic iRNA agent targeting human EGLN3 oligonucleotide
ugggcaaauacuacgucaa

SEQ ID NO: 2002 - RNA, 19 nt, Artificial Sequence
  Description of Artificial Sequence: Synthetic iRNA agent targeting human EGLN3 oligonucleotide
uugacguaguauuugccca

SEQ ID NO: 2003 - RNA, 19 nt, Artificial Sequence
  Description of Artificial Sequence: Synthetic iRNA agent targeting human EGLN3 oligonucleotide
gcaaauacuacgucaagga

SEQ ID NO: 2004 - RNA, 19 nt, Artificial Sequence
  Description of Artificial Sequence: Synthetic iRNA agent targeting human EGLN3 oligonucleotide
uccuugacguaguauuugc

SEQ ID NO: 2005 - RNA, 19 nt, Artificial Sequence
  Description of Artificial Sequence: Synthetic iRNA agent targeting human EGLN3 oligonucleotide
cuacgucaaggagaggucu

SEQ ID NO: 2006 - RNA, 19 nt, Artificial Sequence
  Description of Artificial Sequence: Synthetic iRNA agent targeting human EGLN3 oligonucleotide
agaccucuccuugacguag

SEQ ID NO: 2007 - RNA, 19 nt, Artificial Sequence
  Description of Artificial Sequence: Synthetic iRNA agent targeting human EGLN3 oligonucleotide
uacgucaaggagaggucua

SEQ ID NO: 2008 - RNA, 19 nt, Artificial Sequence
  Description of Artificial Sequence: Synthetic iRNA agent targeting human EGLN3 oligonucleotide
uagaccucuccuugacgua

SEQ ID NO: 2009 - RNA, 19 nt, Artificial Sequence
  Description of Artificial Sequence: Synthetic iRNA agent targeting human EGLN3 oligonucleotide
caaggagaggucuaaggca

SEQ ID NO: 2010 - RNA, 19 nt, Artificial Sequence
  Description of Artificial Sequence: Synthetic iRNA agent targeting human EGLN3 oligonucleotide
ugccuuagaccucuccuug

SEQ ID NO: 2011 - RNA, 19 nt, Artificial Sequence
  Description of Artificial Sequence: Synthetic iRNA agent targeting human EGLN3 oligonucleotide
agaggucuaaggcaauggu

SEQ ID NO: 2012 - RNA, 19 nt, Artificial Sequence
  Description of Artificial Sequence: Synthetic iRNA agent targeting human EGLN3 oligonucleotide
accauugccuuagaccucu

SEQ ID NO: 2013 - RNA, 19 nt, Artificial Sequence
  Description of Artificial Sequence: Synthetic iRNA agent targeting human EGLN3 oligonucleotide
ucuaaggcaaugguggcuu

SEQ ID NO: 2014 - RNA, 19 nt, Artificial Sequence
  Description of Artificial Sequence: Synthetic iRNA agent targeting human EGLN3 oligonucleotide
aagccaccauugccuuaga

SEQ ID NO: 2015 - RNA, 19 nt, Artificial Sequence
  Description of Artificial Sequence: Synthetic iRNA agent targeting human EGLN3 oligonucleotide
aaggcaaugguggcuugcu

SEQ ID NO: 2016 - RNA, 19 nt, Artificial Sequence
  Description of Artificial Sequence: Synthetic iRNA agent targeting human EGLN3 oligonucleotide
agcaagccaccauugccuu

SEQ ID NO: 2017 - RNA, 19 nt, Artificial Sequence
  Description of Artificial Sequence: Synthetic iRNA agent targeting human EGLN3 oligonucleotide
aggcaaugguggcuugcua

SEQ ID NO: 2018 - RNA, 19 nt, Artificial Sequence
  Description of Artificial Sequence: Synthetic iRNA agent targeting human EGLN3 oligonucleotide
uagcaagccaccauugccu

SEQ ID NO: 2019 - RNA, 19 nt, Artificial Sequence
  Description of Artificial Sequence: Synthetic iRNA agent targeting human EGLN3 oligonucleotide
ggcaaugguggcuugcuau

SEQ ID NO: 2020 - RNA, 19 nt, Artificial Sequence
  Description of Artificial Sequence: Synthetic iRNA agent targeting human EGLN3 oligonucleotide
auagcaagccaccauugcc

SEQ ID NO: 2021 - RNA, 19 nt, Artificial Sequence
  Description of Artificial Sequence: Synthetic iRNA agent targeting human EGLN3 oligonucleotide
guggcuugcuauccgggaa

SEQ ID NO: 2022 - RNA, 19 nt, Artificial Sequence
  Description of Artificial Sequence: Synthetic iRNA agent targeting human EGLN3 oligonucleotide
uucccggauagcaagccac

SEQ ID NO: 2023 - RNA, 19 nt, Artificial Sequence
  Description of Artificial Sequence: Synthetic iRNA agent targeting human EGLN3 oligonucleotide
uggcuugcuauccgggaaa

SEQ ID NO: 2024 - RNA, 19 nt, Artificial Sequence
  Description of Artificial Sequence: Synthetic iRNA agent targeting human EGLN3 oligonucleotide
uuucccggauagcaagcca

SEQ ID NO: 2025 - RNA, 19 nt, Artificial Sequence
  Description of Artificial Sequence: Synthetic iRNA agent targeting human EGLN3 oligonucleotide
ggcuugcuauccgggaaau

SEQ ID NO: 2026 - RNA, 19 nt, Artificial Sequence
  Description of Artificial Sequence: Synthetic iRNA agent targeting human EGLN3 oligonucleotide
auuucccggauagcaagcc

SEQ ID NO: 2027 - RNA, 19 nt, Artificial Sequence
  Description of Artificial Sequence: Synthetic iRNA agent targeting human EGLN3 oligonucleotide
ugcuauccgggaaauggaa

SEQ ID NO: 2028 - RNA, 19 nt, Artificial Sequence
  Description of Artificial Sequence: Synthetic iRNA agent targeting human EGLN3 oligonucleotide
uuccauuucccggauagca

SEQ ID NO: 2029 - RNA, 19 nt, Artificial Sequence
  Description of Artificial Sequence: Synthetic iRNA agent targeting human EGLN3 oligonucleotide
ccgggaaauggaacagguu

SEQ ID NO: 2030 - RNA, 19 nt, Artificial Sequence
  Description of Artificial Sequence: Synthetic iRNA agent targeting human EGLN3 oligonucleotide
aaccuguuccauuucccgg

SEQ ID NO: 2031 - RNA, 19 nt, Artificial Sequence
  Description of Artificial Sequence: Synthetic iRNA agent targeting human EGLN3 oligonucleotide
gggaaauggaacagguuau

SEQ ID NO: 2032 - RNA, 19 nt, Artificial Sequence
  Description of Artificial Sequence: Synthetic iRNA agent targeting human EGLN3 oligonucleotide
auaaccuguuccauuuccc

SEQ ID NO: 2033 - RNA, 19 nt, Artificial Sequence
  Description of Artificial Sequence: Synthetic iRNA agent targeting human EGLN3 oligonucleotide
gaacagguuauguucgcca

SEQ ID NO: 2034 - RNA, 19 nt, Artificial Sequence
  Description of Artificial Sequence: Synthetic iRNA agent targeting human EGLN3 oligonucleotide
uggcgaacauaaccuguuc

SEQ ID NO: 2035 - RNA, 19 nt, Artificial Sequence
  Description of Artificial Sequence: Synthetic iRNA agent targeting human EGLN3 oligonucleotide
cagguuauguucgccacgu

SEQ ID NO: 2036 - RNA, 19 nt, Artificial Sequence
  Description of Artificial Sequence: Synthetic iRNA agent targeting human EGLN3 oligonucleotide
acguggcgaacauaaccug

SEQ ID NO: 2037 - RNA, 19 nt, Artificial Sequence
  Description of Artificial Sequence: Synthetic iRNA agent targeting human EGLN3 oligonucleotide
guuauguucgccacgugga

SEQ ID NO: 2038 - RNA, 19 nt, Artificial Sequence
  Description of Artificial Sequence: Synthetic iRNA agent targeting human EGLN3 oligonucleotide
uccacguggcgaacauaac

SEQ ID NO: 2039 - RNA, 19 nt, Artificial Sequence
  Description of Artificial Sequence: Synthetic iRNA agent targeting human EGLN3 oligonucleotide
uauguucgccacguggaca

SEQ ID NO: 2040 - RNA, 19 nt, Artificial Sequence
  Description of Artificial Sequence: Synthetic iRNA agent targeting human EGLN3 oligonucleotide
uguccacguggcgaacaua

SEQ ID NO: 2041 - RNA, 19 nt, Artificial Sequence
  Description of Artificial Sequence: Synthetic iRNA agent targeting human EGLN3 oligonucleotide
auguucgccacguggacaa

SEQ ID NO: 2042 - RNA, 19 nt, Artificial Sequence
  Description of Artificial Sequence: Synthetic iRNA agent targeting human EGLN3 oligonucleotide
uuguccacguggcgaacau

SEQ ID NO: 2043 - RNA, 19 nt, Artificial Sequence
  Description of Artificial Sequence: Synthetic iRNA agent targeting human EGLN3 oligonucleotide
cgccacguggacaacccca

SEQ ID NO: 2044 - RNA, 19 nt, Artificial Sequence
  Description of Artificial Sequence: Synthetic iRNA agent targeting human EGLN3 oligonucleotide
ugggguuguccacguggcg

SEQ ID NO: 2045 - RNA, 19 nt, Artificial Sequence
  Description of Artificial Sequence: Synthetic iRNA agent targeting human EGLN3 oligonucleotide
cguggacaaccccaacggu

SEQ ID NO: 2046 - RNA, 19 nt, Artificial Sequence
  Description of Artificial Sequence: Synthetic iRNA agent targeting human EGLN3 oligonucleotide
accguugggguuguccacg

SEQ ID NO: 2047 - RNA, 19 nt, Artificial Sequence
  Description of Artificial Sequence: Synthetic iRNA agent targeting human EGLN3 oligonucleotide
ggacaaccccaacggugau

SEQ ID NO: 2048 - RNA, 19 nt, Artificial Sequence
  Description of Artificial Sequence: Synthetic iRNA agent targeting human EGLN3 oligonucleotide
aucaccguugggguugucc

SEQ ID NO: 2049 - RNA, 19 nt, Artificial Sequence
  Description of Artificial Sequence: Synthetic iRNA agent targeting human EGLN3 oligonucleotide
caaccccaacggugauggu

SEQ ID NO: 2050 - RNA, 19 nt, Artificial Sequence
  Description of Artificial Sequence: Synthetic iRNA agent targeting human EGLN3 oligonucleotide
accaucaccguugggguug

SEQ ID NO: 2051 - RNA, 19 nt, Artificial Sequence
  Description of Artificial Sequence: Synthetic iRNA agent targeting human EGLN3 oligonucleotide
cccaacggugauggucgcu

SEQ ID NO: 2052 - RNA, 19 nt, Artificial Sequence
  Description of Artificial Sequence: Synthetic iRNA agent targeting human EGLN3 oligonucleotide
agcgaccaucaccguuggg

SEQ ID NO: 2053 - RNA, 19 nt, Artificial Sequence
  Description of Artificial Sequence: Synthetic iRNA agent targeting human EGLN3 oligonucleotide
aacggugauggucgcugca

SEQ ID NO: 2054 - RNA, 19 nt, Artificial Sequence
  Description of Artificial Sequence: Synthetic iRNA agent targeting human EGLN3 oligonucleotide
ugcagcgaccaucaccguu

SEQ ID NO: 2055 - RNA, 19 nt, Artificial Sequence
  Description of Artificial Sequence: Synthetic iRNA agent targeting human EGLN3 oligonucleotide
accugcaucuacuaucuga

SEQ ID NO: 2056 - RNA, 19 nt, Artificial Sequence
  Description of Artificial Sequence: Synthetic iRNA agent targeting human EGLN3 oligonucleotide
ucagauaguagaugcaggu

SEQ ID NO: 2057 - RNA, 19 nt, Artificial Sequence
  Description of Artificial Sequence: Synthetic iRNA agent targeting human EGLN3 oligonucleotide
ccugcaucuacuaucugaa

SEQ ID NO: 2058 - RNA, 19 nt, Artificial Sequence
  Description of Artificial Sequence: Synthetic iRNA agent targeting human EGLN3 oligonucleotide
uucagauaguagaugcagg

SEQ ID NO: 2059 - RNA, 19 nt, Artificial Sequence
  Description of Artificial Sequence: Synthetic iRNA agent targeting human EGLN3 oligonucleotide
agaauugggaugccaagcu

SEQ ID NO: 2060 - RNA, 19 nt, Artificial Sequence
  Description of Artificial Sequence: Synthetic iRNA agent targeting human EGLN3 oligonucleotide
agcuuggcaucccaauucu

SEQ ID NO: 2061 - RNA, 19 nt, Artificial Sequence
  Description of Artificial Sequence: Synthetic iRNA agent targeting human EGLN3 oligonucleotide
gaauugggaugccaagcua

SEQ ID NO: 2062 - RNA, 19 nt, Artificial Sequence
  Description of Artificial Sequence: Synthetic iRNA agent targeting human EGLN3 oligonucleotide
uagcuuggcaucccaauuc

SEQ ID NO: 2063 - RNA, 19 nt, Artificial Sequence
  Description of Artificial Sequence: Synthetic iRNA agent targeting human EGLN3 oligonucleotide
auugggaugccaagcuaca

SEQ ID NO: 2064 - RNA, 19 nt, Artificial Sequence
  Description of Artificial Sequence: Synthetic iRNA agent targeting human EGLN3 oligonucleotide
uguagcuuggcaucccaau

SEQ ID NO: 2065 - RNA, 19 nt, Artificial Sequence
  Description of Artificial Sequence: Synthetic iRNA agent targeting human EGLN3 oligonucleotide
agcuacauggugggauccu

SEQ ID NO: 2066 - RNA, 19 nt, Artificial Sequence
  Description of Artificial Sequence: Synthetic iRNA agent targeting human EGLN3 oligonucleotide
aggaucccaccauguagcu

SEQ ID NO: 2067 - RNA, 19 nt, Artificial Sequence
  Description of Artificial Sequence: Synthetic iRNA agent targeting human EGLN3 oligonucleotide
auggugggauccugcggau

SEQ ID NO: 2068 - RNA, 19 nt, Artificial Sequence
  Description of Artificial Sequence: Synthetic iRNA agent targeting human EGLN3 oligonucleotide
auccgcaggaucccaccau

SEQ ID NO: 2069 - RNA, 19 nt, Artificial Sequence
  Description of Artificial Sequence: Synthetic iRNA agent targeting human EGLN3 oligonucleotide
uggugggauccugcggaua

SEQ ID NO: 2070 - RNA, 19 nt, Artificial Sequence
  Description of Artificial Sequence: Synthetic iRNA agent targeting human EGLN3 oligonucleotide
uauccgcaggaucccacca

SEQ ID NO: 2071 - RNA, 19 nt, Artificial Sequence
  Description of Artificial Sequence: Synthetic iRNA agent targeting human EGLN3 oligonucleotide
ggugggauccugcggauau

SEQ ID NO: 2072 - RNA, 19 nt, Artificial Sequence
  Description of Artificial Sequence: Synthetic iRNA agent targeting human EGLN3 oligonucleotide
auauccgcaggaucccacc

SEQ ID NO: 2073 - RNA, 19 nt, Artificial Sequence
  Description of Artificial Sequence: Synthetic iRNA agent targeting human EGLN3 oligonucleotide
gugggauccugcggauauu

SEQ ID NO: 2074 - RNA, 19 nt, Artificial Sequence
  Description of Artificial Sequence: Synthetic iRNA agent targeting human EGLN3 oligonucleotide
aauauccgcaggaucccac

SEQ ID NO: 2075 - RNA, 19 nt, Artificial Sequence
  Description of Artificial Sequence: Synthetic iRNA agent targeting human EGLN3 oligonucleotide
ugggauccugcggauauuu

SEQ ID NO: 2076 - RNA, 19 nt, Artificial Sequence
  Description of Artificial Sequence: Synthetic iRNA agent targeting human EGLN3 oligonucleotide
aaauauccgcaggauccca

SEQ ID NO: 2077 - RNA, 19 nt, Artificial Sequence
  Description of Artificial Sequence: Synthetic iRNA agent targeting human EGLN3 oligonucleotide
gauccugcggauauuucca

SEQ ID NO: 2078 - RNA, 19 nt, Artificial Sequence
  Description of Artificial Sequence: Synthetic iRNA agent targeting human EGLN3 oligonucleotide
uggaaauauccgcaggauc

SEQ ID NO: 2079 - RNA, 19 nt, Artificial Sequence
  Description of Artificial Sequence: Synthetic iRNA agent targeting human EGLN3 oligonucleotide
uccugcggauauuuccaga

SEQ ID NO: 2080 - RNA, 19 nt, Artificial Sequence
  Description of Artificial Sequence: Synthetic iRNA agent targeting human EGLN3 oligonucleotide
ucuggaaauauccgcagga

SEQ ID NO: 2081 - RNA, 19 nt, Artificial Sequence
  Description of Artificial Sequence: Synthetic iRNA agent targeting human EGLN3 oligonucleotide
cggauauuuccagagggga

SEQ ID NO: 2082 - RNA, 19 nt, Artificial Sequence
  Description of Artificial Sequence: Synthetic iRNA agent targeting human EGLN3 oligonucleotide
uccccucuggaaauauccg

SEQ ID NO: 2083 - RNA, 19 nt, Artificial Sequence
  Description of Artificial Sequence: Synthetic iRNA agent targeting human EGLN3 oligonucleotide
agaggggaaaucauucaua

SEQ ID NO: 2084 - RNA, 19 nt, Artificial Sequence
  Description of Artificial Sequence: Synthetic iRNA agent targeting human EGLN3 oligonucleotide
uaugaaugauuuccccucu

SEQ ID NO: 2085 - RNA, 19 nt, Artificial Sequence
  Description of Artificial Sequence: Synthetic iRNA agent targeting human EGLN3 oligonucleotide
ggggaaaucauucauagca

SEQ ID NO: 2086 - RNA, 19 nt, Artificial Sequence
  Description of Artificial Sequence: Synthetic iRNA agent targeting human EGLN3 oligonucleotide
ugcuaugaaugauuucccc

SEQ ID NO: 2087 - RNA, 19 nt, Artificial Sequence
  Description of Artificial Sequence: Synthetic iRNA agent targeting human EGLN3 oligonucleotide
gaaaucauucauagcagau

SEQ ID NO: 2088 - RNA, 19 nt, Artificial Sequence
  Description of Artificial Sequence: Synthetic iRNA agent targeting human EGLN3 oligonucleotide
aucugcuaugaaugauuuc

SEQ ID NO: 2089 - RNA, 19 nt, Artificial Sequence
  Description of Artificial Sequence: Synthetic iRNA agent targeting human EGLN3 oligonucleotide
guggagcccauuuuugaca

SEQ ID NO: 2090 - RNA, 19 nt, Artificial Sequence
  Description of Artificial Sequence: Synthetic iRNA agent targeting human EGLN3 oligonucleotide
ugucaaaaaugggcuccac

SEQ ID NO: 2091 - RNA, 19 nt, Artificial Sequence
  Description of Artificial Sequence: Synthetic iRNA agent targeting human EGLN3 oligonucleotide
ggagcccauuuuugacaga

SEQ ID NO: 2092 - RNA, 19 nt, Artificial Sequence
  Description of Artificial Sequence: Synthetic iRNA agent targeting human EGLN3 oligonucleotide
ucugucaaaaaugggcucc

SEQ ID NO: 2093 - RNA, 19 nt, Artificial Sequence
  Description of Artificial Sequence: Synthetic iRNA agent targeting human EGLN3 oligonucleotide
agcccauuuuugacagacu

SEQ ID NO: 2094 - RNA, 19 nt, Artificial Sequence
  Description of Artificial Sequence: Synthetic iRNA agent targeting human EGLN3 oligonucleotide
agucugucaaaaaugggcu

SEQ ID NO: 2095 - RNA, 19 nt, Artificial Sequence
  Description of Artificial Sequence: Synthetic iRNA agent targeting human EGLN3 oligonucleotide
uuuuugacagacuccuguu

SEQ ID NO: 2096 - RNA, 19 nt, Artificial Sequence
  Description of Artificial Sequence: Synthetic iRNA agent targeting human EGLN3 oligonucleotide
aacaggagucugucaaaaa

SEQ ID NO: 2097 - RNA, 19 nt, Artificial Sequence
  Description of Artificial Sequence: Synthetic iRNA agent targeting human EGLN3 oligonucleotide
uugacagacuccuguucuu

SEQ ID NO: 2098 - RNA, 19 nt, Artificial Sequence
  Description of Artificial Sequence: Synthetic iRNA agent targeting human EGLN3 oligonucleotide
aagaacaggagucugucaa

SEQ ID NO: 2099 - RNA, 19 nt, Artificial Sequence
  Description of Artificial Sequence: Synthetic iRNA agent targeting human EGLN3 oligonucleotide
gacagacuccuguucuucu

SEQ ID NO: 2100 - RNA, 19 nt, Artificial Sequence
  Description of Artificial Sequence: Synthetic iRNA agent targeting human EGLN3 oligonucleotide
agaagaacaggagucuguc

SEQ ID NO: 2101 - RNA, 19 nt, Artificial Sequence
  Description of Artificial Sequence: Synthetic iRNA agent targeting human EGLN3 oligonucleotide
ccuguucuucuggucagau

SEQ ID NO: 2102 - RNA, 19 nt, Artificial Sequence
  Description of Artificial Sequence: Synthetic iRNA agent targeting human EGLN3 oligonucleotide
aucugaccagaagaacagg

SEQ ID NO: 2103 - RNA, 19 nt, Artificial Sequence
  Description of Artificial Sequence: Synthetic iRNA agent targeting human EGLN3 oligonucleotide
guucuucuggucagaucgu

SEQ ID NO: 2104 - RNA, 19 nt, Artificial Sequence
  Description of Artificial Sequence: Synthetic iRNA agent targeting human EGLN3 oligonucleotide
acgaucugaccagaagaac

SEQ ID NO: 2105 - RNA, 19 nt, Artificial Sequence
  Description of Artificial Sequence: Synthetic iRNA agent targeting human EGLN3 oligonucleotide
uucuucuggucagaucgua

SEQ ID NO: 2106 - RNA, 19 nt, Artificial Sequence
  Description of Artificial Sequence: Synthetic iRNA agent targeting human EGLN3 oligonucleotide
uacgaucugaccagaagaa

SEQ ID NO: 2107 - RNA, 19 nt, Artificial Sequence
  Description of Artificial Sequence: Synthetic iRNA agent targeting human EGLN3 oligonucleotide
uucuggucagaucguagga

SEQ ID NO: 2108 - RNA, 19 nt, Artificial Sequence
  Description of Artificial Sequence: Synthetic iRNA agent targeting human EGLN3 oligonucleotide
uccuacgaucugaccagaa

SEQ ID NO: 2109 - RNA, 19 nt, Artificial Sequence
  Description of Artificial Sequence: Synthetic iRNA agent targeting human EGLN3 oligonucleotide
ucuggucagaucguaggaa

SEQ ID NO: 2110 - RNA, 19 nt, Artificial Sequence
  Description of Artificial Sequence: Synthetic iRNA agent targeting human EGLN3 oligonucleotide
uuccuacgaucugaccaga

SEQ ID NO: 2111 - RNA, 19 nt, Artificial Sequence
  Description of Artificial Sequence: Synthetic iRNA agent targeting human EGLN3 oligonucleotide
gucagaucguaggaaccca

SEQ ID NO: 2112 - RNA, 19 nt, Artificial Sequence
  Description of Artificial Sequence: Synthetic iRNA agent targeting human EGLN3 oligonucleotide
uggguuccuacgaucugac

SEQ ID NO: 2113 - RNA, 19 nt, Artificial Sequence
  Description of Artificial Sequence: Synthetic iRNA agent targeting human EGLN3 oligonucleotide
cagaucguaggaacccaca

SEQ ID NO: 2114 - RNA, 19 nt, Artificial Sequence
  Description of Artificial Sequence: Synthetic iRNA agent targeting human EGLN3 oligonucleotide
uguggguuccuacgaucug

SEQ ID NO: 2115 - RNA, 19 nt, Artificial Sequence
  Description of Artificial Sequence: Synthetic iRNA agent targeting human EGLN3 oligonucleotide
aucguaggaacccacacga

SEQ ID NO: 2116 - RNA, 19 nt, Artificial Sequence
  Description of Artificial Sequence: Synthetic iRNA agent targeting human EGLN3 oligonucleotide
ucguguggguuccuacgau

SEQ ID NO: 2117 - RNA, 19 nt, Artificial Sequence
  Description of Artificial Sequence: Synthetic iRNA agent targeting human EGLN3 oligonucleotide
ucguaggaacccacacgaa

SEQ ID NO: 2118 - RNA, 19 nt, Artificial Sequence
  Description of Artificial Sequence: Synthetic iRNA agent targeting human EGLN3 oligonucleotide
uucguguggguuccuacga

SEQ ID NO: 2119 - RNA, 19 nt, Artificial Sequence
  Description of Artificial Sequence: Synthetic iRNA agent targeting human EGLN3 oligonucleotide
guaggaacccacacgaagu

SEQ ID NO: 2120 - RNA, 19 nt, Artificial Sequence
  Description of Artificial Sequence: Synthetic iRNA agent targeting human EGLN3 oligonucleotide
acuucguguggguuccuac

SEQ ID NO: 2121 - RNA, 19 nt, Artificial Sequence
  Description of Artificial Sequence: Synthetic iRNA agent targeting human EGLN3 oligonucleotide
ggaacccacacgaagugca

SEQ ID NO: 2122 - RNA, 19 nt, Artificial Sequence
  Description of Artificial Sequence: Synthetic iRNA agent targeting human EGLN3 oligonucleotide
ugcacuucguguggguucc

SEQ ID NO: 2123 - RNA, 19 nt, Artificial Sequence
  Description of Artificial Sequence: Synthetic iRNA agent targeting human EGLN3 oligonucleotide
agugcagcccucuuacgca

SEQ ID NO: 2124 - RNA, 19 nt, Artificial Sequence
  Description of Artificial Sequence: Synthetic iRNA agent targeting human EGLN3 oligonucleotide
ugcguaagagggcugcacu

SEQ ID NO: 2125 - RNA, 19 nt, Artificial Sequence
  Description of Artificial Sequence: Synthetic iRNA agent targeting human EGLN3 oligonucleotide
gugcagcccucuuacgcaa

SEQ ID NO: 2126 - RNA, 19 nt, Artificial Sequence
  Description of Artificial Sequence: Synthetic iRNA agent targeting human EGLN3 oligonucleotide
uugcguaagagggcugcac

SEQ ID NO: 2127 - RNA, 19 nt, Artificial Sequence
  Description of Artificial Sequence: Synthetic iRNA agent targeting human EGLN3 oligonucleotide
cagcccucuuacgcaacca

SEQ ID NO: 2128 - RNA, 19 nt, Artificial Sequence
  Description of Artificial Sequence: Synthetic iRNA agent targeting human EGLN3 oligonucleotide
ugguugcguaagagggcug

SEQ ID NO: 2129 - RNA, 19 nt, Artificial Sequence
  Description of Artificial Sequence: Synthetic iRNA agent targeting human EGLN3 oligonucleotide
gcccucuuacgcaaccaga

SEQ ID NO: 2130 - RNA, 19 nt, Artificial Sequence
  Description of Artificial Sequence: Synthetic iRNA agent targeting human EGLN3 oligonucleotide
ucugguugcguaagagggc

SEQ ID NO: 2131 - RNA, 19 nt, Artificial Sequence
  Description of Artificial Sequence: Synthetic iRNA agent targeting human EGLN3 oligonucleotide
cucuuacgcaaccagauau

SEQ ID NO: 2132 - RNA, 19 nt, Artificial Sequence
  Description of Artificial Sequence: Synthetic iRNA agent targeting human EGLN3 oligonucleotide
auaucugguugcguaagag

SEQ ID NO: 2133 - RNA, 19 nt, Artificial Sequence
  Description of Artificial Sequence: Synthetic iRNA agent targeting human EGLN3 oligonucleotide
uuacgcaaccagauaugcu

SEQ ID NO: 2134 - RNA, 19 nt, Artificial Sequence
  Description of Artificial Sequence: Synthetic iRNA agent targeting human EGLN3 oligonucleotide
agcauaucugguugcguaa

SEQ ID NO: 2135 - RNA, 19 nt, Artificial Sequence
  Description of Artificial Sequence: Synthetic iRNA agent targeting human EGLN3 oligonucleotide
gcaaccagauaugcuauga

SEQ ID NO: 2136 - RNA, 19 nt, Artificial Sequence
  Description of Artificial Sequence: Synthetic iRNA agent targeting human EGLN3 oligonucleotide
ucauagcauaucugguugc

SEQ ID NO: 2137 - RNA, 19 nt, Artificial Sequence
  Description of Artificial Sequence: Synthetic iRNA agent targeting human EGLN3 oligonucleotide
aaccagauaugcuaugacu

SEQ ID NO: 2138 - RNA, 19 nt, Artificial Sequence
  Description of Artificial Sequence: Synthetic iRNA agent targeting human EGLN3 oligonucleotide
agucauagcauaucugguu

SEQ ID NO: 2139 - RNA, 19 nt, Artificial Sequence
  Description of Artificial Sequence: Synthetic iRNA agent targeting human EGLN3 oligonucleotide
ccagauaugcuaugacugu

SEQ ID NO: 2140 - RNA, 19 nt, Artificial Sequence
  Description of Artificial Sequence: Synthetic iRNA agent targeting human EGLN3 oligonucleotide
acagucauagcauaucugg

SEQ ID NO: 2141 - RNA, 19 nt, Artificial Sequence
  Description of Artificial Sequence: Synthetic iRNA agent targeting human EGLN3 oligonucleotide
uaugcuaugacugucuggu

SEQ ID NO: 2142 - RNA, 19 nt, Artificial Sequence
  Description of Artificial Sequence: Synthetic iRNA agent targeting human EGLN3 oligonucleotide
accagacagucauagcaua

SEQ ID NO: 2143 - RNA, 19 nt, Artificial Sequence
  Description of Artificial Sequence: Synthetic iRNA agent targeting human EGLN3 oligonucleotide
augcuaugacugucuggua

SEQ ID NO: 2144 - RNA, 19 nt, Artificial Sequence
  Description of Artificial Sequence: Synthetic iRNA agent targeting human EGLN3 oligonucleotide
uaccagacagucauagcau

SEQ ID NO: 2145 - RNA, 19 nt, Artificial Sequence
  Description of Artificial Sequence: Synthetic iRNA agent targeting human EGLN3 oligonucleotide
cuaugacugucugguacuu

SEQ ID NO: 2146 - RNA, 19 nt, Artificial Sequence
  Description of Artificial Sequence: Synthetic iRNA agent targeting human EGLN3 oligonucleotide
aaguaccagacagucauag

SEQ ID NO: 2147 - RNA, 19 nt, Artificial Sequence
  Description of Artificial Sequence: Synthetic iRNA agent targeting human EGLN3 oligonucleotide
ucugguacuuugaugcuga

SEQ ID NO: 2148 - RNA, 19 nt, Artificial Sequence
  Description of Artificial Sequence: Synthetic iRNA agent targeting human EGLN3 oligonucleotide
ucagcaucaaaguaccaga

SEQ ID NO: 2149 - RNA, 19 nt, Artificial Sequence
  Description of Artificial Sequence: Synthetic iRNA agent targeting human EGLN3 oligonucleotide
agaaagggcagaagccaaa

SEQ ID NO: 2150 - RNA, 19 nt, Artificial Sequence
  Description of Artificial Sequence: Synthetic iRNA agent targeting human EGLN3 oligonucleotide
uuuggcuucugcccuuucu

SEQ ID NO: 2151 - RNA, 19 nt, Artificial Sequence
  Description of Artificial Sequence: Synthetic iRNA agent targeting human EGLN3 oligonucleotide
agggcagaagccaaaaaga

SEQ ID NO: 2152 - RNA, 19 nt, Artificial Sequence
  Description of Artificial Sequence: Synthetic iRNA agent targeting human EGLN3 oligonucleotide
ucuuuuuggcuucugcccu

SEQ ID NO: 2153 - RNA, 19 nt, Artificial Sequence
  Description of Artificial Sequence: Synthetic iRNA agent targeting human EGLN3 oligonucleotide
gaaauucaggaauuuaacu

SEQ ID NO: 2154 - RNA, 19 nt, Artificial Sequence
  Description of Artificial Sequence: Synthetic iRNA agent targeting human EGLN3 oligonucleotide
aguuaaauuccugaauuuc

SEQ ID NO: 2155 - RNA, 19 nt, Artificial Sequence
  Description of Artificial Sequence: Synthetic iRNA agent targeting human EGLN3 oligonucleotide
aaauucaggaauuuaacua

SEQ ID NO: 2156 - RNA, 19 nt, Artificial Sequence
  Description of Artificial Sequence: Synthetic iRNA agent targeting human EGLN3 oligonucleotide
uaguuaaauuccugaauuu

SEQ ID NO: 2157 - RNA, 19 nt, Artificial Sequence
  Description of Artificial Sequence: Synthetic iRNA agent targeting human EGLN3 oligonucleotide
uucaggaauuuaacuagga

SEQ ID NO: 2158 - RNA, 19 nt, Artificial Sequence
  Description of Artificial Sequence: Synthetic iRNA agent targeting human EGLN3 oligonucleotide
uccuaguuaaauuccugaa

SEQ ID NO: 2159 - RNA, 19 nt, Artificial Sequence
  Description of Artificial Sequence: Synthetic iRNA agent targeting human EGLN3 oligonucleotide
ucaggaauuuaacuaggaa

SEQ ID NO: 2160 - RNA, 19 nt, Artificial Sequence
  Description of Artificial Sequence: Synthetic iRNA agent targeting human EGLN3 oligonucleotide
uuccuaguuaaauuccuga

SEQ ID NO: 2161 - RNA, 19 nt, Artificial Sequence
  Description of Artificial Sequence: Synthetic iRNA agent targeting human EGLN3 oligonucleotide
aggaauuuaacuaggaaaa

SEQ ID NO: 2162 - RNA, 19 nt, Artificial Sequence
  Description of Artificial Sequence: Synthetic iRNA agent targeting human EGLN3 oligonucleotide
uuuuccuaguuaaauuccu

SEQ ID NO: 2163 - RNA, 19 nt, Artificial Sequence
  Description of Artificial Sequence: Synthetic iRNA agent targeting human EGLN3 oligonucleotide
uuuaacuaggaaaacugaa

SEQ ID NO: 2164 - RNA, 19 nt, Artificial Sequence
  Description of Artificial Sequence: Synthetic iRNA agent targeting human EGLN3 oligonucleotide
uucaguuuuccuaguuaaa

SEQ ID NO: 2165 - RNA, 19 nt, Artificial Sequence
  Description of Artificial Sequence: Synthetic iRNA agent targeting human EGLN3 oligonucleotide
ggaaaacugaaucugcccu

SEQ ID NO: 2166 - RNA, 19 nt, Artificial Sequence
  Description of Artificial Sequence: Synthetic iRNA agent targeting human EGLN3 oligonucleotide
agggcagauucaguuuucc

SEQ ID NO: 2167 - RNA, 19 nt, Artificial Sequence
  Description of Artificial Sequence: Synthetic iRNA agent targeting human EGLN3 oligonucleotide
aacugaaucugcccucacu

SEQ ID NO: 2168 - RNA, 19 nt, Artificial Sequence
  Description of Artificial Sequence: Synthetic iRNA agent targeting human EGLN3 oligonucleotide
agugagggcagauucaguu

SEQ ID NO: 2169 - RNA, 19 nt, Artificial Sequence
  Description of Artificial Sequence: Synthetic iRNA agent targeting human EGLN3 oligonucleotide
ugaaucugcccucacugaa

SEQ ID NO: 2170 - RNA, 19 nt, Artificial Sequence
  Description of Artificial Sequence: Synthetic iRNA agent targeting human EGLN3 oligonucleotide
uucagugagggcagauuca

SEQ ID NO: 2171 - RNA, 19 nt, Artificial Sequence
  Description of Artificial Sequence: Synthetic iRNA agent targeting human EGLN3 oligonucleotide
cucacugaagacugaccgu

SEQ ID NO: 2172 - RNA, 19 nt, Artificial Sequence
  Description of Artificial Sequence: Synthetic iRNA agent targeting human EGLN3 oligonucleotide
acggucagucuucagugag

SEQ ID NO: 2173 - RNA, 19 nt, Artificial Sequence
  Description of Artificial Sequence: Synthetic iRNA agent targeting human EGLN3 oligonucleotide
ugaagacugaccgugcucu

SEQ ID NO: 2174 - RNA, 19 nt, Artificial Sequence
  Description of Artificial Sequence: Synthetic iRNA agent targeting human EGLN3 oligonucleotide
agagcacggucagucuuca

SEQ ID NO: 2175 - RNA, 19 nt, Artificial Sequence
  Description of Artificial Sequence: Synthetic iRNA agent targeting human EGLN3 oligonucleotide
aagacugaccgugcucuga

SEQ ID NO: 2176 - RNA, 19 nt, Artificial Sequence
  Description of Artificial Sequence: Synthetic iRNA agent targeting human EGLN3 oligonucleotide
ucagagcacggucagucuu

SEQ ID NO: 2177 - RNA, 19 nt, Artificial Sequence
  Description of Artificial Sequence: Synthetic iRNA agent targeting human EGLN3 oligonucleotide
agacugaccgugcucugaa

SEQ ID NO: 2178 - RNA, 19 nt, Artificial Sequence
  Description of Artificial Sequence: Synthetic iRNA agent targeting human EGLN3 oligonucleotide
uucagagcacggucagucu

SEQ ID NO: 2179 - RNA, 19 nt, Artificial Sequence
  Description of Artificial Sequence: Synthetic iRNA agent targeting human EGLN3 oligonucleotide
ugaccgugcucugaaaucu

SEQ ID NO: 2180 - RNA, 19 nt, Artificial Sequence
  Description of Artificial Sequence: Synthetic iRNA agent targeting human EGLN3 oligonucleotide
agauuucagagcacgguca

SEQ ID NO: 2181 - RNA, 19 nt, Artificial Sequence
  Description of Artificial Sequence: Synthetic iRNA agent targeting human EGLN3 oligonucleotide
cucugaaaucugcuggccu

SEQ ID NO: 2182 - RNA, 19 nt, Artificial Sequence
  Description of Artificial Sequence: Synthetic iRNA agent targeting human EGLN3 oligonucleotide
aggccagcagauuucagag

SEQ ID NO: 2183 - RNA, 19 nt, Artificial Sequence
  Description of Artificial Sequence: Synthetic iRNA agent targeting human EGLN3 oligonucleotide
ucugaaaucugcuggccuu

SEQ ID NO: 2184 - RNA, 19 nt, Artificial Sequence
  Description of Artificial Sequence: Synthetic iRNA agent targeting human EGLN3 oligonucleotide
aaggccagcagauuucaga

SEQ ID NO: 2185 - RNA, 19 nt, Artificial Sequence
  Description of Artificial Sequence: Synthetic iRNA agent targeting human EGLN3 oligonucleotide
ucugcuggccuuguucauu

SEQ ID NO: 2186 - RNA, 19 nt, Artificial Sequence
  Description of Artificial Sequence: Synthetic iRNA agent targeting human EGLN3 oligonucleotide
aaugaacaaggccagcaga

SEQ ID NO: 2187 - RNA, 19 nt, Artificial Sequence
  Description of Artificial Sequence: Synthetic iRNA agent targeting human EGLN3 oligonucleotide
ugcuggccuuguucauuuu

SEQ ID NO: 2188 - RNA, 19 nt, Artificial Sequence
  Description of Artificial Sequence: Synthetic iRNA agent targeting human EGLN3 oligonucleotide
aaaaugaacaaggccagca

SEQ ID NO: 2189 - RNA, 19 nt, Artificial Sequence
  Description of Artificial Sequence: Synthetic iRNA agent targeting human EGLN3 oligonucleotide
uguucauuuuaguaacggu

SEQ ID NO: 2190 - RNA, 19 nt, Artificial Sequence
  Description of Artificial Sequence: Synthetic iRNA agent targeting human EGLN3 oligonucleotide
accguuacuaaaaugaaca

SEQ ID NO: 2191 - RNA, 19 nt, Artificial Sequence
  Description of Artificial Sequence: Synthetic iRNA agent targeting human EGLN3 oligonucleotide
guucauuuuaguaacgguu

SEQ ID NO: 2192 - RNA, 19 nt, Artificial Sequence
  Description of Artificial Sequence: Synthetic iRNA agent targeting human EGLN3 oligonucleotide
aaccguuacuaaaaugaac

SEQ ID NO: 2193 - RNA, 19 nt, Artificial Sequence
  Description of Artificial Sequence: Synthetic iRNA agent targeting human EGLN3 oligonucleotide
cauuuuaguaacgguuccu

SEQ ID NO: 2194 - RNA, 19 nt, Artificial Sequence
  Description of Artificial Sequence: Synthetic iRNA agent targeting human EGLN3 oligonucleotide
aggaaccguuacuaaaaug

SEQ ID NO: 2195 - RNA, 19 nt, Artificial Sequence
  Description of Artificial Sequence: Synthetic iRNA agent targeting human EGLN3 oligonucleotide
uuuaguaacgguuccugaa

SEQ ID NO: 2196 - RNA, 19 nt, Artificial Sequence
  Description of Artificial Sequence: Synthetic iRNA agent targeting human EGLN3 oligonucleotide
uucaggaaccguuacuaaa

SEQ ID NO: 2197 - RNA, 19 nt, Artificial Sequence
  Description of Artificial Sequence: Synthetic iRNA agent targeting human EGLN3 oligonucleotide
uuaguaacgguuccugaau

SEQ ID NO: 2198 - RNA, 19 nt, Artificial Sequence
  Description of Artificial Sequence: Synthetic iRNA agent targeting human EGLN3 oligonucleotide
auucaggaaccguuacuaa

SEQ ID NO: 2199 - RNA, 19 nt, Artificial Sequence
  Description of Artificial Sequence: Synthetic iRNA agent targeting human EGLN3 oligonucleotide
uaguaacgguuccugaauu

SEQ ID NO: 2200 - RNA, 19 nt, Artificial Sequence
  Description of Artificial Sequence: Synthetic iRNA agent targeting human EGLN3 oligonucleotide
aauucaggaaccguuacua

SEQ ID NO: 2201 - RNA, 19 nt, Artificial Sequence
  Description of Artificial Sequence: Synthetic iRNA agent targeting human EGLN3 oligonucleotide
guaacgguuccugaauucu

SEQ ID NO: 2202 - RNA, 19 nt, Artificial Sequence
  Description of Artificial Sequence: Synthetic iRNA agent targeting human EGLN3 oligonucleotide
agaauucaggaaccguuac

SEQ ID NO: 2203 - RNA, 19 nt, Artificial Sequence
  Description of Artificial Sequence: Synthetic iRNA agent targeting human EGLN3 oligonucleotide
aacgguuccugaauucucu

SEQ ID NO: 2204 - RNA, 19 nt, Artificial Sequence
  Description of Artificial Sequence: Synthetic iRNA agent targeting human EGLN3 oligonucleotide
agagaauucaggaaccguu

SEQ ID NO: 2205 - RNA, 19 nt, Artificial Sequence
  Description of Artificial Sequence: Synthetic iRNA agent targeting human EGLN3 oligonucleotide
guuccugaauucucuuaaa

SEQ ID NO: 2206 - RNA, 19 nt, Artificial Sequence
  Description of Artificial Sequence: Synthetic iRNA agent targeting human EGLN3 oligonucleotide
uuuaagagaauucaggaac

SEQ ID NO: 2207 - RNA, 19 nt, Artificial Sequence
  Description of Artificial Sequence: Synthetic iRNA agent targeting human EGLN3 oligonucleotide
cugaauucucuuaaauucu

SEQ ID NO: 2208 - RNA, 19 nt, Artificial Sequence
  Description of Artificial Sequence: Synthetic iRNA agent targeting human EGLN3 oligonucleotide
agaauuuaagagaauucag

SEQ ID NO: 2209 - RNA, 19 nt, Artificial Sequence
  Description of Artificial Sequence: Synthetic iRNA agent targeting human EGLN3 oligonucleotide
ugagauccaaagauggccu

SEQ ID NO: 2210 - RNA, 19 nt, Artificial Sequence
  Description of Artificial Sequence: Synthetic iRNA agent targeting human EGLN3 oligonucleotide
aggccaucuuuggaucuca

SEQ ID NO: 2211 - RNA, 19 nt, Artificial Sequence
  Description of Artificial Sequence: Synthetic iRNA agent targeting human EGLN3 oligonucleotide
gauccaaagauggccucuu

SEQ ID NO: 2212 - RNA, 19 nt, Artificial Sequence
  Description of Artificial Sequence: Synthetic iRNA agent targeting human EGLN3 oligonucleotide
aagaggccaucuuuggauc

SEQ ID NO: 2213 - RNA, 19 nt, Artificial Sequence
  Description of Artificial Sequence: Synthetic iRNA agent targeting human EGLN3 oligonucleotide
caaagauggccucuucagu

SEQ ID NO: 2214 - RNA, 19 nt, Artificial Sequence
  Description of Artificial Sequence: Synthetic iRNA agent targeting human EGLN3 oligonucleotide
acugaagaggccaucuuug

SEQ ID NO: 2215 - RNA, 19 nt, Artificial Sequence
  Description of Artificial Sequence: Synthetic iRNA agent targeting human EGLN3 oligonucleotide
ugacaacaaucucccugcu

SEQ ID NO: 2216 - RNA, 19 nt, Artificial Sequence
  Description of Artificial Sequence: Synthetic iRNA agent targeting human EGLN3 oligonucleotide
agcagggagauuguuguca

SEQ ID NO: 2217 - RNA, 19 nt, Artificial Sequence
  Description of Artificial Sequence: Synthetic iRNA agent targeting human EGLN3 oligonucleotide
aacaaucucccugcuacuu

SEQ ID NO: 2218 - RNA, 19 nt, Artificial Sequence
  Description of Artificial Sequence: Synthetic iRNA agent targeting human EGLN3 oligonucleotide
aaguagcagggagauuguu

SEQ ID NO: 2219 - RNA, 19 nt, Artificial Sequence
  Description of Artificial Sequence: Synthetic iRNA agent targeting human EGLN3 oligonucleotide
ucccugcuacuucuugcau

SEQ ID NO: 2220 - RNA, 19 nt, Artificial Sequence
  Description of Artificial Sequence: Synthetic iRNA agent targeting human EGLN3 oligonucleotide
augcaagaaguagcaggga

SEQ ID NO: 2221 - RNA, 19 nt, Artificial Sequence
  Description of Artificial Sequence: Synthetic iRNA agent targeting human EGLN3 oligonucleotide
cugcuacuucuugcauccu

SEQ ID NO: 2222 - RNA, 19 nt, Artificial Sequence
  Description of Artificial Sequence: Synthetic iRNA agent targeting human EGLN3 oligonucleotide
aggaugcaagaaguagcag

SEQ ID NO: 2223 - RNA, 19 nt, Artificial Sequence
  Description of Artificial Sequence: Synthetic iRNA agent targeting human EGLN3 oligonucleotide
ugcuacuucuugcauccuu

SEQ ID NO: 2224 - RNA, 19 nt, Artificial Sequence
  Description of Artificial Sequence: Synthetic iRNA agent targeting human EGLN3 oligonucleotide
aaggaugcaagaaguagca

SEQ ID NO: 2225 - RNA, 19 nt, Artificial Sequence
  Description of Artificial Sequence: Synthetic iRNA agent targeting human EGLN3 oligonucleotide
cccugucuuguguguggua

SEQ ID NO: 2226 - RNA, 19 nt, Artificial Sequence
  Description of Artificial Sequence: Synthetic iRNA agent targeting human EGLN3 oligonucleotide
uaccacacacaagacaggg

SEQ ID NO: 2227 - RNA, 19 nt, Artificial Sequence
  Description of Artificial Sequence: Synthetic iRNA agent targeting human EGLN3 oligonucleotide
ucuugugugugguacuuca

SEQ ID NO: 2228 - RNA, 19 nt, Artificial Sequence
  Description of Artificial Sequence: Synthetic iRNA agent targeting human EGLN3 oligonucleotide
ugaaguaccacacacaaga

SEQ ID NO: 2229 - RNA, 19 nt, Artificial Sequence
  Description of Artificial Sequence: Synthetic iRNA agent targeting human EGLN3 oligonucleotide
cuugugugugguacuucau

SEQ ID NO: 2230 - RNA, 19 nt, Artificial Sequence
  Description of Artificial Sequence: Synthetic iRNA agent targeting human EGLN3 oligonucleotide
augaaguaccacacacaag

SEQ ID NO: 2231 - RNA, 19 nt, Artificial Sequence
  Description of Artificial Sequence: Synthetic iRNA agent targeting human EGLN3 oligonucleotide
ugugugguacuucauguuu

SEQ ID NO: 2232 - RNA, 19 nt, Artificial Sequence
  Description of Artificial Sequence: Synthetic iRNA agent targeting human EGLN3 oligonucleotide
aaacaugaaguaccacaca

SEQ ID NO: 2233 - RNA, 19 nt, Artificial Sequence
  Description of Artificial Sequence: Synthetic iRNA agent targeting human EGLN3 oligonucleotide
acuucauguuuucuugcca

SEQ ID NO: 2234 - RNA, 19 nt, Artificial Sequence
  Description of Artificial Sequence: Synthetic iRNA agent targeting human EGLN3 oligonucleotide
uggcaagaaaacaugaagu

SEQ ID NO: 2235 - RNA, 19 nt, Artificial Sequence
  Description of Artificial Sequence: Synthetic iRNA agent targeting human EGLN3 oligonucleotide
guuuucuugccaagacugu

SEQ ID NO: 2236 - RNA, 19 nt, Artificial Sequence
  Description of Artificial Sequence: Synthetic iRNA agent targeting human EGLN3 oligonucleotide
acagucuuggcaagaaaac

SEQ ID NO: 2237 - RNA, 19 nt, Artificial Sequence
  Description of Artificial Sequence: Synthetic iRNA agent targeting human EGLN3 oligonucleotide
uucuugccaagacuguguu

SEQ ID NO: 2238 - RNA, 19 nt, Artificial Sequence
  Description of Artificial Sequence: Synthetic iRNA agent targeting human EGLN3 oligonucleotide
aacacagucuuggcaagaa

SEQ ID NO: 2239 - RNA, 19 nt, Artificial Sequence
  Description of Artificial Sequence: Synthetic iRNA agent targeting human EGLN3 oligonucleotide
guguugaucuucagauacu

SEQ ID NO: 2240 - RNA, 19 nt, Artificial Sequence
  Description of Artificial Sequence: Synthetic iRNA agent targeting human EGLN3 oligonucleotide
aguaucugaagaucaacac

SEQ ID NO: 2241 - RNA, 19 nt, Artificial Sequence
  Description of Artificial Sequence: Synthetic iRNA agent targeting human EGLN3 oligonucleotide
ugaucuucagauacucucu

SEQ ID NO: 2242 - RNA, 19 nt, Artificial Sequence
  Description of Artificial Sequence: Synthetic iRNA agent targeting human EGLN3 oligonucleotide
agagaguaucugaagauca

SEQ ID NO: 2243 - RNA, 19 nt, Artificial Sequence
  Description of Artificial Sequence: Synthetic iRNA agent targeting human EGLN3 oligonucleotide
ucagauacucucuuugcca

SEQ ID NO: 2244 - RNA, 19 nt, Artificial Sequence
  Description of Artificial Sequence: Synthetic iRNA agent targeting human EGLN3 oligonucleotide
uggcaaagagaguaucuga

SEQ ID NO: 2245 - RNA, 19 nt, Artificial Sequence
  Description of Artificial Sequence: Synthetic iRNA agent targeting human EGLN3 oligonucleotide
agauacucucuuugccaga

SEQ ID NO: 2246 - RNA, 19 nt, Artificial Sequence
  Description of Artificial Sequence: Synthetic iRNA agent targeting human EGLN3 oligonucleotide
ucuggcaaagagaguaucu

SEQ ID NO: 2247 - RNA, 19 nt, Artificial Sequence
  Description of Artificial Sequence: Synthetic iRNA agent targeting human EGLN3 oligonucleotide
uacucucuuugccagauga

SEQ ID NO: 2248 - RNA, 19 nt, Artificial Sequence
  Description of Artificial Sequence: Synthetic iRNA agent targeting human EGLN3 oligonucleotide
ucaucuggcaaagagagua

SEQ ID NO: 2249 - RNA, 19 nt, Artificial Sequence
  Description of Artificial Sequence: Synthetic iRNA agent targeting human EGLN3 oligonucleotide
acucucuuugccagaugaa

SEQ ID NO: 2250 - RNA, 19 nt, Artificial Sequence
  Description of Artificial Sequence: Synthetic iRNA agent targeting human EGLN3 oligonucleotide
uucaucuggcaaagagagu

SEQ ID NO: 2251 - RNA, 19 nt, Artificial Sequence
  Description of Artificial Sequence: Synthetic iRNA agent targeting human EGLN3 oligonucleotide
uugccagaugaaguuacuu

SEQ ID NO: 2252 - RNA, 19 nt, Artificial Sequence
  Description of Artificial Sequence: Synthetic iRNA agent targeting human EGLN3 oligonucleotide
aaguaacuucaucuggcaa

SEQ ID NO: 2253 - RNA, 19 nt, Artificial Sequence
  Description of Artificial Sequence: Synthetic iRNA agent targeting human EGLN3 oligonucleotide
cagaugaaguuacuugcua

SEQ ID NO: 2254 - RNA, 19 nt, Artificial Sequence
  Description of Artificial Sequence: Synthetic iRNA agent targeting human EGLN3 oligonucleotide
uagcaaguaacuucaucug

SEQ ID NO: 2255 - RNA, 19 nt, Artificial Sequence
  Description of Artificial Sequence: Synthetic iRNA agent targeting human EGLN3 oligonucleotide
agaugaaguuacuugcuaa

SEQ ID NO: 2256 - RNA, 19 nt, Artificial Sequence
  Description of Artificial Sequence: Synthetic iRNA agent targeting human EGLN3 oligonucleotide
uuagcaaguaacuucaucu

SEQ ID NO: 2257 - RNA, 19 nt, Artificial Sequence
  Description of Artificial Sequence: Synthetic iRNA agent targeting human EGLN3 oligonucleotide
augaaguuacuugcuaacu

SEQ ID NO: 2258 - RNA, 19 nt, Artificial Sequence
  Description of Artificial Sequence: Synthetic iRNA agent targeting human EGLN3 oligonucleotide
aguuagcaaguaacuucau

SEQ ID NO: 2259 - RNA, 19 nt, Artificial Sequence
  Description of Artificial Sequence: Synthetic iRNA agent targeting human EGLN3 oligonucleotide
aaguuacuugcuaacucca

SEQ ID NO: 2260 - RNA, 19 nt, Artificial Sequence
  Description of Artificial Sequence: Synthetic iRNA agent targeting human EGLN3 oligonucleotide
uggaguuagcaaguaacuu

SEQ ID NO: 2261 - RNA, 19 nt, Artificial Sequence
  Description of Artificial Sequence: Synthetic iRNA agent targeting human EGLN3 oligonucleotide
uacuugcuaacuccagaaa

SEQ ID NO: 2262 - RNA, 19 nt, Artificial Sequence
  Description of Artificial Sequence: Synthetic iRNA agent targeting human EGLN3 oligonucleotide
uuucuggaguuagcaagua

SEQ ID NO: 2263 - RNA, 19 nt, Artificial Sequence
  Description of Artificial Sequence: Synthetic iRNA agent targeting human EGLN3 oligonucleotide
gcuaacuccagaaauuccu

SEQ ID NO: 2264 - RNA, 19 nt, Artificial Sequence
  Description of Artificial Sequence: Synthetic iRNA agent targeting human EGLN3 oligonucleotide
aggaauuucuggaguuagc

SEQ ID NO: 2265 - RNA, 19 nt, Artificial Sequence
  Description of Artificial Sequence: Synthetic iRNA agent targeting human EGLN3 oligonucleotide
aauuccugcagacauccua

SEQ ID NO: 2266 - RNA, 19 nt, Artificial Sequence
  Description of Artificial Sequence: Synthetic iRNA agent targeting human EGLN3 oligonucleotide
uaggaugucugcaggaauu

SEQ ID NO: 2267 - RNA, 19 nt, Artificial Sequence
  Description of Artificial Sequence: Synthetic iRNA agent targeting human EGLN3 oligonucleotide
uuccugcagacauccuacu

SEQ ID NO: 2268 - RNA, 19 nt, Artificial Sequence
  Description of Artificial Sequence: Synthetic iRNA agent targeting human EGLN3 oligonucleotide
aguaggaugucugcaggaa

SEQ ID NO: 2269 - RNA, 19 nt, Artificial Sequence
  Description of Artificial Sequence: Synthetic iRNA agent targeting human EGLN3 oligonucleotide
ccuacucggccagcgguuu

SEQ ID NO: 2270 - RNA, 19 nt, Artificial Sequence
  Description of Artificial Sequence: Synthetic iRNA agent targeting human EGLN3 oligonucleotide
aaaccgcuggccgaguagg

SEQ ID NO: 2271 - RNA, 19 nt, Artificial Sequence
  Description of Artificial Sequence: Synthetic iRNA agent targeting human EGLN3 oligonucleotide
cuacucggccagcgguuua

SEQ ID NO: 2272 - RNA, 19 nt, Artificial Sequence
  Description of Artificial Sequence: Synthetic iRNA agent targeting human EGLN3 oligonucleotide
uaaaccgcuggccgaguag

SEQ ID NO: 2273 - RNA, 19 nt, Artificial Sequence
  Description of Artificial Sequence: Synthetic iRNA agent targeting human EGLN3 oligonucleotide
cucggccagcgguuuaccu

SEQ ID NO: 2274 - RNA, 19 nt, Artificial Sequence
  Description of Artificial Sequence: Synthetic iRNA agent targeting human EGLN3 oligonucleotide
agguaaaccgcuggccgag

SEQ ID NO: 2275 - RNA, 19 nt, Artificial Sequence
  Description of Artificial Sequence: Synthetic iRNA agent targeting human EGLN3 oligonucleotide
ggccagcgguuuaccugau

SEQ ID NO: 2276 - RNA, 19 nt, Artificial Sequence
  Description of Artificial Sequence: Synthetic iRNA agent targeting human EGLN3 oligonucleotide
aucagguaaaccgcuggcc

SEQ ID NO: 2277 - RNA, 19 nt, Artificial Sequence
  Description of Artificial Sequence: Synthetic iRNA agent targeting human EGLN3 oligonucleotide
gccagcgguuuaccugaua

SEQ ID NO: 2278 - RNA, 19 nt, Artificial Sequence
  Description of Artificial Sequence: Synthetic iRNA agent targeting human EGLN3 oligonucleotide
uaucagguaaaccgcuggc

SEQ ID NO: 2279 - RNA, 19 nt, Artificial Sequence
  Description of Artificial Sequence: Synthetic iRNA agent targeting human EGLN3 oligonucleotide
cagcgguuuaccugauaga

SEQ ID NO: 2280 - RNA, 19 nt, Artificial Sequence
  Description of Artificial Sequence: Synthetic iRNA agent targeting human EGLN3 oligonucleotide
ucuaucagguaaaccgcug

SEQ ID NO: 2281 - RNA, 19 nt, Artificial Sequence
  Description of Artificial Sequence: Synthetic iRNA agent targeting human EGLN3 oligonucleotide
agcgguuuaccugauagau

SEQ ID NO: 2282 - RNA, 19 nt, Artificial Sequence
  Description of Artificial Sequence: Synthetic iRNA agent targeting human EGLN3 oligonucleotide
aucuaucagguaaaccgcu

SEQ ID NO: 2283 - RNA, 19 nt, Artificial Sequence
  Description of Artificial Sequence: Synthetic iRNA agent targeting human EGLN3 oligonucleotide
gcgguuuaccugauagauu

SEQ ID NO: 2284 - RNA, 19 nt, Artificial Sequence
  Description of Artificial Sequence: Synthetic iRNA agent targeting human EGLN3 oligonucleotide
aaucuaucagguaaaccgc

SEQ ID NO: 2285 - RNA, 19 nt, Artificial Sequence
  Description of Artificial Sequence: Synthetic iRNA agent targeting human EGLN3 oligonucleotide
uuuaccugauagauucggu

SEQ ID NO: 2286 - RNA, 19 nt, Artificial Sequence
  Description of Artificial Sequence: Synthetic iRNA agent targeting human EGLN3 oligonucleotide
accgaaucuaucagguaaa

SEQ ID NO: 2287 - RNA, 19 nt, Artificial Sequence
  Description of Artificial Sequence: Synthetic iRNA agent targeting human EGLN3 oligonucleotide
uuaccugauagauucggua

SEQ ID NO: 2288 - RNA, 19 nt, Artificial Sequence
  Description of Artificial Sequence: Synthetic iRNA agent targeting human EGLN3 oligonucleotide
uaccgaaucuaucagguaa

SEQ ID NO: 2289 - RNA, 19 nt, Artificial Sequence
  Description of Artificial Sequence: Synthetic iRNA agent targeting human EGLN3 oligonucleotide
uaccugauagauucgguaa

SEQ ID NO: 2290 - RNA, 19 nt, Artificial Sequence
  Description of Artificial Sequence: Synthetic iRNA agent targeting human EGLN3 oligonucleotide
uuaccgaaucuaucaggua

SEQ ID NO: 2291 - RNA, 19 nt, Artificial Sequence
  Description of Artificial Sequence: Synthetic iRNA agent targeting human EGLN3 oligonucleotide
accugauagauucgguaau

SEQ ID NO: 2292 - RNA, 19 nt, Artificial Sequence
  Description of Artificial Sequence: Synthetic iRNA agent targeting human EGLN3 oligonucleotide
auuaccgaaucuaucaggu

SEQ ID NO: 2293 - RNA, 19 nt, Artificial Sequence
  Description of Artificial Sequence: Synthetic iRNA agent targeting human EGLN3 oligonucleotide
ccugauagauucgguaaua

SEQ ID NO: 2294 - RNA, 19 nt, Artificial Sequence
  Description of Artificial Sequence: Synthetic iRNA agent targeting human EGLN3 oligonucleotide
uauuaccgaaucuaucagg

SEQ ID NO: 2295 - RNA, 19 nt, Artificial Sequence
  Description of Artificial Sequence: Synthetic iRNA agent targeting human EGLN3 oligonucleotide
ugauagauucgguaauacu

SEQ ID NO: 2296 - RNA, 19 nt, Artificial Sequence
  Description of Artificial Sequence: Synthetic iRNA agent targeting human EGLN3 oligonucleotide
aguauuaccgaaucuauca

SEQ ID NO: 2297 - RNA, 19 nt, Artificial Sequence
  Description of Artificial Sequence: Synthetic iRNA agent targeting human EGLN3 oligonucleotide
gauagauucgguaauacua

SEQ ID NO: 2298 - RNA, 19 nt, Artificial Sequence
  Description of Artificial Sequence: Synthetic iRNA agent targeting human EGLN3 oligonucleotide
uaguauuaccgaaucuauc

SEQ ID NO: 2299 - RNA, 19 nt, Artificial Sequence
  Description of Artificial Sequence: Synthetic iRNA agent targeting human EGLN3 oligonucleotide
agauucgguaauacuauca

SEQ ID NO: 2300 - RNA, 19 nt, Artificial Sequence
  Description of Artificial Sequence: Synthetic iRNA agent targeting human EGLN3 oligonucleotide
ugauaguauuaccgaaucu

SEQ ID NO: 2301 - RNA, 19 nt, Artificial Sequence
  Description of Artificial Sequence: Synthetic iRNA agent targeting human EGLN3 oligonucleotide
acuaucaagagaagagccu

SEQ ID NO: 2302 - RNA, 19 nt, Artificial Sequence
  Description of Artificial Sequence: Synthetic iRNA agent targeting human EGLN3 oligonucleotide
aggcucuucucuugauagu

SEQ ID NO: 2303 - RNA, 19 nt, Artificial Sequence
  Description of Artificial Sequence: Synthetic iRNA agent targeting human EGLN3 oligonucleotide
ucaagagaagagccuagga

SEQ ID NO: 2304 - RNA, 19 nt, Artificial Sequence
  Description of Artificial Sequence: Synthetic iRNA agent targeting human EGLN3 oligonucleotide
uccuaggcucuucucuuga

SEQ ID NO: 2305 - RNA, 19 nt, Artificial Sequence
  Description of Artificial Sequence: Synthetic iRNA agent targeting human EGLN3 oligonucleotide
aggagcacagcgagggaau

SEQ ID NO: 2306 - RNA, 19 nt, Artificial Sequence
  Description of Artificial Sequence: Synthetic iRNA agent targeting human EGLN3 oligonucleotide
auucccucgcugugcuccu

SEQ ID NO: 2307 - RNA, 19 nt, Artificial Sequence
  Description of Artificial Sequence: Synthetic iRNA agent targeting human EGLN3 oligonucleotide
gagcacagcgagggaauga

SEQ ID NO: 2308 - RNA, 19 nt, Artificial Sequence
  Description of Artificial Sequence: Synthetic iRNA agent targeting human EGLN3 oligonucleotide
ucauucccucgcugugcuc

SEQ ID NO: 2309 - RNA, 19 nt, Artificial Sequence
  Description of Artificial Sequence: Synthetic iRNA agent targeting human EGLN3 oligonucleotide
agcacagcgagggaaugaa

SEQ ID NO: 2310 - RNA, 19 nt, Artificial Sequence
  Description of Artificial Sequence: Synthetic iRNA agent targeting human EGLN3 oligonucleotide
uucauucccucgcugugcu

SEQ ID NO: 2311 - RNA, 19 nt, Artificial Sequence
  Description of Artificial Sequence: Synthetic iRNA agent targeting human EGLN3 oligonucleotide
acagcgagggaaugaaccu

SEQ ID NO: 2312 - RNA, 19 nt, Artificial Sequence
  Description of Artificial Sequence: Synthetic iRNA agent targeting human EGLN3 oligonucleotide
agguucauucccucgcugu

SEQ ID NO: 2313 - RNA, 19 nt, Artificial Sequence
  Description of Artificial Sequence: Synthetic iRNA agent targeting human EGLN3 oligonucleotide
cagcgagggaaugaaccuu

SEQ ID NO: 2314 - RNA, 19 nt, Artificial Sequence
  Description of Artificial Sequence: Synthetic iRNA agent targeting human EGLN3 oligonucleotide
aagguucauucccucgcug

SEQ ID NO: 2315 - RNA, 19 nt, Artificial Sequence
  Description of Artificial Sequence: Synthetic iRNA agent targeting human EGLN3 oligonucleotide
agcgagggaaugaaccuua

SEQ ID NO: 2316 - RNA, 19 nt, Artificial Sequence
  Description of Artificial Sequence: Synthetic iRNA agent targeting human EGLN3 oligonucleotide
uaagguucauucccucgcu

SEQ ID NO: 2317 - RNA, 19 nt, Artificial Sequence
  Description of Artificial Sequence: Synthetic iRNA agent targeting human EGLN3 oligonucleotide
aaugaaccuuacuugcacu

SEQ ID NO: 2318 - RNA, 19 nt, Artificial Sequence
  Description of Artificial Sequence: Synthetic iRNA agent targeting human EGLN3 oligonucleotide
agugcaaguaagguucauu

SEQ ID NO: 2319 - RNA, 19 nt, Artificial Sequence
  Description of Artificial Sequence: Synthetic iRNA agent targeting human EGLN3 oligonucleotide
augaaccuuacuugcacuu

SEQ ID NO: 2320 - RNA, 19 nt, Artificial Sequence
  Description of Artificial Sequence: Synthetic iRNA agent targeting human EGLN3 oligonucleotide
aagugcaaguaagguucau

SEQ ID NO: 2321 - RNA, 19 nt, Artificial Sequence
  Description of Artificial Sequence: Synthetic iRNA agent targeting human EGLN3 oligonucleotide
ugaaccuuacuugcacuuu

SEQ ID NO: 2322 - RNA, 19 nt, Artificial Sequence
  Description of Artificial Sequence: Synthetic iRNA agent targeting human EGLN3 oligonucleotide
aaagugcaaguaagguuca

SEQ ID NO: 2323 - RNA, 19 nt, Artificial Sequence
  Description of Artificial Sequence: Synthetic iRNA agent targeting human EGLN3 oligonucleotide
cuuacuugcacuuuaugua

SEQ ID NO: 2324 - RNA, 19 nt, Artificial Sequence
  Description of Artificial Sequence: Synthetic iRNA agent targeting human EGLN3 oligonucleotide
uacauaaagugcaaguaag

SEQ ID NO: 2325 - RNA, 19 nt, Artificial Sequence
  Description of Artificial Sequence: Synthetic iRNA agent targeting human EGLN3 oligonucleotide
uuacuugcacuuuauguau

SEQ ID NO: 2326 - RNA, 19 nt, Artificial Sequence
  Description of Artificial Sequence: Synthetic iRNA agent targeting human EGLN3 oligonucleotide
auacauaaagugcaaguaa

SEQ ID NO: 2327 - RNA, 19 nt, Artificial Sequence
  Description of Artificial Sequence: Synthetic iRNA agent targeting human EGLN3 oligonucleotide
cacuuuauguauacuuccu

SEQ ID NO: 2328 - RNA, 19 nt, Artificial Sequence
  Description of Artificial Sequence: Synthetic iRNA agent targeting human EGLN3 oligonucleotide
aggaaguauacauaaagug

SEQ ID NO: 2329 - RNA, 19 nt, Artificial Sequence
  Description of Artificial Sequence: Synthetic iRNA agent targeting human EGLN3 oligonucleotide
uuuauguauacuuccugau

SEQ ID NO: 2330 - RNA, 19 nt, Artificial Sequence
  Description of Artificial Sequence: Synthetic iRNA agent targeting human EGLN3 oligonucleotide
aucaggaaguauacauaaa

SEQ ID NO: 2331 - RNA, 19 nt, Artificial Sequence
  Description of Artificial Sequence: Synthetic iRNA agent targeting human EGLN3 oligonucleotide
uuauguauacuuccugauu

SEQ ID NO: 2332 - RNA, 19 nt, Artificial Sequence
  Description of Artificial Sequence: Synthetic iRNA agent targeting human EGLN3 oligonucleotide
aaucaggaaguauacauaa

SEQ ID NO: 2333 - RNA, 19 nt, Artificial Sequence
  Description of Artificial Sequence: Synthetic iRNA agent targeting human EGLN3 oligonucleotide
guauacuuccugauuugaa

SEQ ID NO: 2334 - RNA, 19 nt, Artificial Sequence
  Description of Artificial Sequence: Synthetic iRNA agent targeting human EGLN3 oligonucleotide
uucaaaucaggaaguauac

SEQ ID NO: 2335 - RNA, 19 nt, Artificial Sequence
  Description of Artificial Sequence: Synthetic iRNA agent targeting human EGLN3 oligonucleotide
uauacuuccugauuugaaa

SEQ ID NO: 2336 - RNA, 19 nt, Artificial Sequence
  Description of Artificial Sequence: Synthetic iRNA agent targeting human EGLN3 oligonucleotide
uuucaaaucaggaaguaua

SEQ ID NO: 2337 - RNA, 19 nt, Artificial Sequence
  Description of Artificial Sequence: Synthetic iRNA agent targeting human EGLN3 oligonucleotide
auuugaaaggaggagguuu

SEQ ID NO: 2338 - RNA, 19 nt, Artificial Sequence
  Description of Artificial Sequence: Synthetic iRNA agent targeting human EGLN3 oligonucleotide
aaaccuccuccuuucaaau

SEQ ID NO: 2339 - RNA, 19 nt, Artificial Sequence
  Description of Artificial Sequence: Synthetic iRNA agent targeting human EGLN3 oligonucleotide
uugaaaggaggagguuuga

SEQ ID NO: 2340 - RNA, 19 nt, Artificial Sequence
  Description of Artificial Sequence: Synthetic iRNA agent targeting human EGLN3 oligonucleotide
ucaaaccuccuccuuucaa

SEQ ID NO: 2341 - RNA, 19 nt, Artificial Sequence
  Description of Artificial Sequence: Synthetic iRNA agent targeting human EGLN3 oligonucleotide
gaaaaaaauggagguggua

SEQ ID NO: 2342 - RNA, 19 nt, Artificial Sequence
  Description of Artificial Sequence: Synthetic iRNA agent targeting human EGLN3 oligonucleotide
uaccaccuccauuuuuuuc

SEQ ID NO: 2343 - RNA, 19 nt, Artificial Sequence
  Description of Artificial Sequence: Synthetic iRNA agent targeting human EGLN3 oligonucleotide
aaaaauggaggugguagau

SEQ ID NO: 2344 - RNA, 19 nt, Artificial Sequence
  Description of Artificial Sequence: Synthetic iRNA agent targeting human EGLN3 oligonucleotide
aucuaccaccuccauuuuu

SEQ ID NO: 2345 - RNA, 19 nt, Artificial Sequence
  Description of Artificial Sequence: Synthetic iRNA agent targeting human EGLN3 oligonucleotide
ggaggugguagaugccaca

SEQ ID NO: 2346 - RNA, 19 nt, Artificial Sequence
  Description of Artificial Sequence: Synthetic iRNA agent targeting human EGLN3 oligonucleotide
uguggcaucuaccaccucc

SEQ ID NO: 2347 - RNA, 19 nt, Artificial Sequence
  Description of Artificial Sequence: Synthetic iRNA agent targeting human EGLN3 oligonucleotide
uagaugccacagagaggca

SEQ ID NO: 2348 - RNA, 19 nt, Artificial Sequence
  Description of Artificial Sequence: Synthetic iRNA agent targeting human EGLN3 oligonucleotide
ugccucucuguggcaucua

SEQ ID NO: 2349 - RNA, 19 nt, Artificial Sequence
  Description of Artificial Sequence: Synthetic iRNA agent targeting human EGLN3 oligonucleotide
cacagagaggcaucacgga

SEQ ID NO: 2350 - RNA, 19 nt, Artificial Sequence
  Description of Artificial Sequence: Synthetic iRNA agent targeting human EGLN3 oligonucleotide
uccgugaugccucucugug

SEQ ID NO: 2351 - RNA, 19 nt, Artificial Sequence
  Description of Artificial Sequence: Synthetic iRNA agent targeting human EGLN3 oligonucleotide
ggcaucacggaagccuuaa

SEQ ID NO: 2352 - RNA, 19 nt, Artificial Sequence
  Description of Artificial Sequence: Synthetic iRNA agent targeting human EGLN3 oligonucleotide
uuaaggcuuccgugaugcc

SEQ ID NO: 2353 - RNA, 19 nt, Artificial Sequence
  Description of Artificial Sequence: Synthetic iRNA agent targeting human EGLN3 oligonucleotide
caucacggaagccuuaaca

SEQ ID NO: 2354 - RNA, 19 nt, Artificial Sequence
  Description of Artificial Sequence: Synthetic iRNA agent targeting human EGLN3 oligonucleotide
uguuaaggcuuccgugaug

SEQ ID NO: 2355 - RNA, 19 nt, Artificial Sequence
  Description of Artificial Sequence: Synthetic iRNA agent targeting human EGLN3 oligonucleotide
cacggaagccuuaacagca

SEQ ID NO: 2356 - RNA, 19 nt, Artificial Sequence
  Description of Artificial Sequence: Synthetic iRNA agent targeting human EGLN3 oligonucleotide
ugcuguuaaggcuuccgug

SEQ ID NO: 2357 - RNA, 19 nt, Artificial Sequence
  Description of Artificial Sequence: Synthetic iRNA agent targeting human EGLN3 oligonucleotide
gaaacagagaaauuugugu

SEQ ID NO: 2358 - RNA, 19 nt, Artificial Sequence
  Description of Artificial Sequence: Synthetic iRNA agent targeting human EGLN3 oligonucleotide
acacaaauuucucuguuuc

SEQ ID NO: 2359 - RNA, 19 nt, Artificial Sequence
  Description of Artificial Sequence: Synthetic iRNA agent targeting human EGLN3 oligonucleotide
auuugugucaucugaacaa

SEQ ID NO: 2360 - RNA, 19 nt, Artificial Sequence
  Description of Artificial Sequence: Synthetic iRNA agent targeting human EGLN3 oligonucleotide
uuguucagaugacacaaau

SEQ ID NO: 2361 - RNA, 19 nt, Artificial Sequence
  Description of Artificial Sequence: Synthetic iRNA agent targeting human EGLN3 oligonucleotide
ugaacaauuuccagauguu

SEQ ID NO: 2362 - RNA, 19 nt, Artificial Sequence
  Description of Artificial Sequence: Synthetic iRNA agent targeting human EGLN3 oligonucleotide
aacaucuggaaauuguuca

SEQ ID NO: 2363 - RNA, 19 nt, Artificial Sequence
  Description of Artificial Sequence: Synthetic iRNA agent targeting human EGLN3 oligonucleotide
aacaauuuccagauguucu

SEQ ID NO: 2364 - RNA, 19 nt, Artificial Sequence
  Description of Artificial Sequence: Synthetic iRNA agent targeting human EGLN3 oligonucleotide
agaacaucuggaaauuguu

SEQ ID NO: 2365 - RNA, 19 nt, Artificial Sequence
  Description of Artificial Sequence: Synthetic iRNA agent targeting human EGLN3 oligonucleotide
acaauuuccagauguucuu

SEQ ID NO: 2366 - RNA, 19 nt, Artificial Sequence
  Description of Artificial Sequence: Synthetic iRNA agent targeting human EGLN3 oligonucleotide
aagaacaucuggaaauugu

SEQ ID NO: 2367 - RNA, 19 nt, Artificial Sequence
  Description of Artificial Sequence: Synthetic iRNA agent targeting human EGLN3 oligonucleotide
aauuuccagauguucuuaa

SEQ ID NO: 2368 - RNA, 19 nt, Artificial Sequence
  Description of Artificial Sequence: Synthetic iRNA agent targeting human EGLN3 oligonucleotide
uuaagaacaucuggaaauu

SEQ ID NO: 2369 - RNA, 19 nt, Artificial Sequence
  Description of Artificial Sequence: Synthetic iRNA agent targeting human EGLN3 oligonucleotide
auguucuuaauccagggcu

SEQ ID NO: 2370 - RNA, 19 nt, Artificial Sequence
  Description of Artificial Sequence: Synthetic iRNA agent targeting human EGLN3 oligonucleotide
agcccuggauuaagaacau

SEQ ID NO: 2371 - RNA, 19 nt, Artificial Sequence
  Description of Artificial Sequence: Synthetic iRNA agent targeting human EGLN3 oligonucleotide
ugggguuucuggagaauua

SEQ ID NO: 2372 - RNA, 19 nt, Artificial Sequence
  Description of Artificial Sequence: Synthetic iRNA agent targeting human EGLN3 oligonucleotide
uaauucuccagaaacccca

SEQ ID NO: 2373 - RNA, 19 nt, Artificial Sequence
  Description of Artificial Sequence: Synthetic iRNA agent targeting human EGLN3 oligonucleotide
uuucuggagaauuaucaca

SEQ ID NO: 2374 - RNA, 19 nt, Artificial Sequence
  Description of Artificial Sequence: Synthetic iRNA agent targeting human EGLN3 oligonucleotide
ugugauaauucuccagaaa

SEQ ID NO: 2375 - RNA, 19 nt, Artificial Sequence
  Description of Artificial Sequence: Synthetic iRNA agent targeting human EGLN3 oligonucleotide
uggagaauuaucacaaccu

SEQ ID NO: 2376 - RNA, 19 nt, Artificial Sequence
  Description of Artificial Sequence: Synthetic iRNA agent targeting human EGLN3 oligonucleotide
agguugugauaauucucca

SEQ ID NO: 2377 - RNA, 19 nt, Artificial Sequence
  Description of Artificial Sequence: Synthetic iRNA agent targeting human EGLN3 oligonucleotide
ggagaauuaucacaaccua

SEQ ID NO: 2378 - RNA, 19 nt, Artificial Sequence
  Description of Artificial Sequence: Synthetic iRNA agent targeting human EGLN3 oligonucleotide
uagguugugauaauucucc

SEQ ID NO: 2379 - RNA, 19 nt, Artificial Sequence
  Description of Artificial Sequence: Synthetic iRNA agent targeting human EGLN3 oligonucleotide
gagaauuaucacaaccuaa

SEQ ID NO: 2380 - RNA, 19 nt, Artificial Sequence
  Description of Artificial Sequence: Synthetic iRNA agent targeting human EGLN3 oligonucleotide
uuagguugugauaauucuc

SEQ ID NO: 2381 - RNA, 19 nt, Artificial Sequence
  Description of Artificial Sequence: Synthetic iRNA agent targeting human EGLN3 oligonucleotide
agaauuaucacaaccuaau

SEQ ID NO: 2382 - RNA, 19 nt, Artificial Sequence
  Description of Artificial Sequence: Synthetic iRNA agent targeting human EGLN3 oligonucleotide
auuagguugugauaauucu

SEQ ID NO: 2383 - RNA, 19 nt, Artificial Sequence
  Description of Artificial Sequence: Synthetic iRNA agent targeting human EGLN3 oligonucleotide
aauuaucacaaccuaauga

SEQ ID NO: 2384 - RNA, 19 nt, Artificial Sequence
  Description of Artificial Sequence: Synthetic iRNA agent targeting human EGLN3 oligonucleotide
ucauuagguugugauaauu

SEQ ID NO: 2385 - RNA, 19 nt, Artificial Sequence
  Description of Artificial Sequence: Synthetic iRNA agent targeting human EGLN3 oligonucleotide
aucacaaccuaaugacauu

SEQ ID NO: 2386 - RNA, 19 nt, Artificial Sequence
  Description of Artificial Sequence: Synthetic iRNA agent targeting human EGLN3 oligonucleotide
aaugucauuagguugugau

SEQ ID NO: 2387 - RNA, 19 nt, Artificial Sequence
  Description of Artificial Sequence: Synthetic iRNA agent targeting human EGLN3 oligonucleotide
ucacaaccuaaugacauua

SEQ ID NO: 2388 - RNA, 19 nt, Artificial Sequence
  Description of Artificial Sequence: Synthetic iRNA agent targeting human EGLN3 oligonucleotide
uaaugucauuagguuguga

SEQ ID NO: 2389 - RNA, 19 nt, Artificial Sequence
  Description of Artificial Sequence: Synthetic iRNA agent targeting human EGLN3 oligonucleotide
ccuaaugacauuaauaccu

SEQ ID NO: 2390 - RNA, 19 nt, Artificial Sequence
  Description of Artificial Sequence: Synthetic iRNA agent targeting human EGLN3 oligonucleotide
agguauuaaugucauuagg

SEQ ID NO: 2391 - RNA, 19 nt, Artificial Sequence
  Description of Artificial Sequence: Synthetic iRNA agent targeting human EGLN3 oligonucleotide
uaaugacauuaauaccucu

SEQ ID NO: 2392 - RNA, 19 nt, Artificial Sequence
  Description of Artificial Sequence: Synthetic iRNA agent targeting human EGLN3 oligonucleotide
agagguauuaaugucauua

SEQ ID NO: 2393 - RNA, 19 nt, Artificial Sequence
  Description of Artificial Sequence: Synthetic iRNA agent targeting human EGLN3 oligonucleotide
gacauuaauaccucuagaa

SEQ ID NO: 2394 - RNA, 19 nt, Artificial Sequence
  Description of Artificial Sequence: Synthetic iRNA agent targeting human EGLN3 oligonucleotide
uucuagagguauuaauguc

SEQ ID NO: 2395 - RNA, 19 nt, Artificial Sequence
  Description of Artificial Sequence: Synthetic iRNA agent targeting human EGLN3 oligonucleotide
aauaccucuagaaagggcu

SEQ ID NO: 2396 - RNA, 19 nt, Artificial Sequence
  Description of Artificial Sequence: Synthetic iRNA agent targeting human EGLN3 oligonucleotide
agcccuuucuagagguauu

SEQ ID NO: 2397 - RNA, 19 nt, Artificial Sequence
  Description of Artificial Sequence: Synthetic iRNA agent targeting human EGLN3 oligonucleotide
aaagggcugcugucauagu

SEQ ID NO: 2398 - RNA, 19 nt, Artificial Sequence
  Description of Artificial Sequence: Synthetic iRNA agent targeting human EGLN3 oligonucleotide
acuaugacagcagcccuuu

SEQ ID NO: 2399 - RNA, 19 nt, Artificial Sequence
  Description of Artificial Sequence: Synthetic iRNA agent targeting human EGLN3 oligonucleotide
agggcugcugucauaguga

SEQ ID NO: 2400 - RNA, 19 nt, Artificial Sequence
  Description of Artificial Sequence: Synthetic iRNA agent targeting human EGLN3 oligonucleotide
ucacuaugacagcagcccu

SEQ ID NO: 2401 - RNA, 19 nt, Artificial Sequence
  Description of Artificial Sequence: Synthetic iRNA agent targeting human EGLN3 oligonucleotide
gggcugcugucauagugaa

SEQ ID NO: 2402 - RNA, 19 nt, Artificial Sequence
  Description of Artificial Sequence: Synthetic iRNA agent targeting human EGLN3 oligonucleotide
uucacuaugacagcagccc

SEQ ID NO: 2403 - RNA, 19 nt, Artificial Sequence
  Description of Artificial Sequence: Synthetic iRNA agent targeting human EGLN3 oligonucleotide
gcugcugucauagugaaca

SEQ ID NO: 2404 - RNA, 19 nt, Artificial Sequence
  Description of Artificial Sequence: Synthetic iRNA agent targeting human EGLN3 oligonucleotide
uguucacuaugacagcagc

SEQ ID NO: 2405 - RNA, 19 nt, Artificial Sequence
  Description of Artificial Sequence: Synthetic iRNA agent targeting human EGLN3 oligonucleotide
ugcugucauagugaacaau

SEQ ID NO: 2406 - RNA, 19 nt, Artificial Sequence
  Description of Artificial Sequence: Synthetic iRNA agent targeting human EGLN3 oligonucleotide
auuguucacuaugacagca

SEQ ID NO: 2407 - RNA, 19 nt, Artificial Sequence
  Description of Artificial Sequence: Synthetic iRNA agent targeting human EGLN3 oligonucleotide
ucauagugaacaauuuaua

SEQ ID NO: 2408 - RNA, 19 nt, Artificial Sequence
  Description of Artificial Sequence: Synthetic iRNA agent targeting human EGLN3 oligonucleotide
uauaaauuguucacuauga

SEQ ID NO: 2409 - RNA, 19 nt, Artificial Sequence
  Description of Artificial Sequence: Synthetic iRNA agent targeting human EGLN3 oligonucleotide
cauagugaacaauuuauaa

SEQ ID NO: 2410 - RNA, 19 nt, Artificial Sequence
  Description of Artificial Sequence: Synthetic iRNA agent targeting human EGLN3 oligonucleotide
uuauaaauuguucacuaug

SEQ ID NO: 2411 - RNA, 19 nt, Artificial Sequence
  Description of Artificial Sequence: Synthetic iRNA agent targeting human EGLN3 oligonucleotide
auaagugucccauggggca

SEQ ID NO: 2412 - RNA, 19 nt, Artificial Sequence
  Description of Artificial Sequence: Synthetic iRNA agent targeting human EGLN3 oligonucleotide
ugccccaugggacacuuau

SEQ ID NO: 2413 - RNA, 19 nt, Artificial Sequence
  Description of Artificial Sequence: Synthetic iRNA agent targeting human EGLN3 oligonucleotide
cauggggcagacacuccuu

SEQ ID NO: 2414 - RNA, 19 nt, Artificial Sequence
  Description of Artificial Sequence: Synthetic iRNA agent targeting human EGLN3 oligonucleotide
aaggagugucugccccaug

SEQ ID NO: 2415 - RNA, 19 nt, Artificial Sequence
  Description of Artificial Sequence: Synthetic iRNA agent targeting human EGLN3 oligonucleotide
auggggcagacacuccuuu

SEQ ID NO: 2416 - RNA, 19 nt, Artificial Sequence
  Description of Artificial Sequence: Synthetic iRNA agent targeting human EGLN3 oligonucleotide
aaaggagugucugccccau

SEQ ID NO: 2417 - RNA, 19 nt, Artificial Sequence
  Description of Artificial Sequence: Synthetic iRNA agent targeting human EGLN3 oligonucleotide
ggggcagacacuccuuuuu

SEQ ID NO: 2418 - RNA, 19 nt, Artificial Sequence
  Description of Artificial Sequence: Synthetic iRNA agent targeting human EGLN3 oligonucleotide
aaaaaggagugucugcccc

SEQ ID NO: 2419 - RNA, 19 nt, Artificial Sequence
  Description of Artificial Sequence: Synthetic iRNA agent targeting human EGLN3 oligonucleotide
gggcagacacuccuuuuuu

SEQ ID NO: 2420 - RNA, 19 nt, Artificial Sequence
  Description of Artificial Sequence: Synthetic iRNA agent targeting human EGLN3 oligonucleotide
aaaaaaggagugucugccc

SEQ ID NO: 2421 - RNA, 19 nt, Artificial Sequence
  Description of Artificial Sequence: Synthetic iRNA agent targeting human EGLN3 oligonucleotide
cuuuuuucccaguccugca

SEQ ID NO: 2422 - RNA, 19 nt, Artificial Sequence
  Description of Artificial Sequence: Synthetic iRNA agent targeting human EGLN3 oligonucleotide
ugcaggacugggaaaaaag

SEQ ID NO: 2423 - RNA, 19 nt, Artificial Sequence
  Description of Artificial Sequence: Synthetic iRNA agent targeting human EGLN3 oligonucleotide
uuucccaguccugcaaccu

SEQ ID NO: 2424 - RNA, 19 nt, Artificial Sequence
  Description of Artificial Sequence: Synthetic iRNA agent targeting human EGLN3 oligonucleotide
agguugcaggacugggaaa

SEQ ID NO: 2425 - RNA, 19 nt, Artificial Sequence
  Description of Artificial Sequence: Synthetic iRNA agent targeting human EGLN3 oligonucleotide
caguccugcaaccuggauu

SEQ ID NO: 2426 - RNA, 19 nt, Artificial Sequence
  Description of Artificial Sequence: Synthetic iRNA agent targeting human EGLN3 oligonucleotide
aauccagguugcaggacug

SEQ ID NO: 2427 - RNA, 19 nt, Artificial Sequence
  Description of Artificial Sequence: Synthetic iRNA agent targeting human EGLN3 oligonucleotide
guccugcaaccuggauuuu

SEQ ID NO: 2428 - RNA, 19 nt, Artificial Sequence
  Description of Artificial Sequence: Synthetic iRNA agent targeting human EGLN3 oligonucleotide
aaaauccagguugcaggac

SEQ ID NO: 2429 - RNA, 19 nt, Artificial Sequence
  Description of Artificial Sequence: Synthetic iRNA agent targeting human EGLN3 oligonucleotide
caaccuggauuuucugccu

SEQ ID NO: 2430 - RNA, 19 nt, Artificial Sequence
  Description of Artificial Sequence: Synthetic iRNA agent targeting human EGLN3 oligonucleotide
aggcagaaaauccagguug

SEQ ID NO: 2431 - RNA, 19 nt, Artificial Sequence
  Description of Artificial Sequence: Synthetic iRNA agent targeting human EGLN3 oligonucleotide
cucagccccauuuugcuga

SEQ ID NO: 2432 - RNA, 19 nt, Artificial Sequence
  Description of Artificial Sequence: Synthetic iRNA agent targeting human EGLN3 oligonucleotide
ucagcaaaauggggcugag

SEQ ID NO: 2433 - RNA, 19 nt, Artificial Sequence
  Description of Artificial Sequence: Synthetic iRNA agent targeting human EGLN3 oligonucleotide
augacuuucugaauaaaga

SEQ ID NO: 2434 - RNA, 19 nt, Artificial Sequence
  Description of Artificial Sequence: Synthetic iRNA agent targeting human EGLN3 oligonucleotide
ucuuuauucagaaagucau

SEQ ID NO: 2435 - RNA, 19 nt, Artificial Sequence
  Description of Artificial Sequence: Synthetic iRNA agent targeting human EGLN3 oligonucleotide
ugacuuucugaauaaagau

SEQ ID NO: 2436 - RNA, 19 nt, Artificial Sequence
  Description of Artificial Sequence: Synthetic iRNA agent targeting human EGLN3 oligonucleotide
aucuuuauucagaaaguca

SEQ ID NO: 2437 - RNA, 19 nt, Artificial Sequence
  Description of Artificial Sequence: Synthetic iRNA agent targeting human EGLN3 oligonucleotide
gaauaaagauggcaacaca

SEQ ID NO: 2438 - RNA, 19 nt, Artificial Sequence
  Description of Artificial Sequence: Synthetic iRNA agent targeting human EGLN3 oligonucleotide
uguguugccaucuuuauuc

SEQ ID NO: 2439 - RNA, 19 nt, Artificial Sequence
  Description of Artificial Sequence: Synthetic iRNA agent targeting human EGLN3 oligonucleotide
ccauuuucaguucuuaccu

SEQ ID NO: 2440 - RNA, 19 nt, Artificial Sequence
  Description of Artificial Sequence: Synthetic iRNA agent targeting human EGLN3 oligonucleotide
agguaagaacugaaaaugg

SEQ ID NO: 2441 - RNA, 19 nt, Artificial Sequence
  Description of Artificial Sequence: Synthetic iRNA agent targeting human EGLN3 oligonucleotide
uuucaguucuuaccuggga

SEQ ID NO: 2442 - RNA, 19 nt, Artificial Sequence
  Description of Artificial Sequence: Synthetic iRNA agent targeting human EGLN3 oligonucleotide
ucccagguaagaacugaaa

SEQ ID NO: 2443 - RNA, 19 nt, Artificial Sequence
  Description of Artificial Sequence: Synthetic iRNA agent targeting human EGLN3 oligonucleotide
uucaguucuuaccugggaa

SEQ ID NO: 2444 - RNA, 19 nt, Artificial Sequence
  Description of Artificial Sequence: Synthetic iRNA agent targeting human EGLN3 oligonucleotide
uucccagguaagaacugaa

SEQ ID NO: 2445 - RNA, 19 nt, Artificial Sequence
  Description of Artificial Sequence: Synthetic iRNA agent targeting human EGLN3 oligonucleotide
guucuuaccugggaaccua

SEQ ID NO: 2446 - RNA, 19 nt, Artificial Sequence
  Description of Artificial Sequence: Synthetic iRNA agent targeting human EGLN3 oligonucleotide
uagguucccagguaagaac

SEQ ID NO: 2447 - RNA, 19 nt, Artificial Sequence
  Description of Artificial Sequence: Synthetic iRNA agent targeting human EGLN3 oligonucleotide
uucuuaccugggaaccuaa

SEQ ID NO: 2448 - RNA, 19 nt, Artificial Sequence
  Description of Artificial Sequence: Synthetic iRNA agent targeting human EGLN3 oligonucleotide
uuagguucccagguaagaa

SEQ ID NO: 2449 - RNA, 19 nt, Artificial Sequence
  Description of Artificial Sequence: Synthetic iRNA agent targeting human EGLN3 oligonucleotide
ucuuaccugggaaccuaau

SEQ ID NO: 2450 - RNA, 19 nt, Artificial Sequence
  Description of Artificial Sequence: Synthetic iRNA agent targeting human EGLN3 oligonucleotide
auuagguucccagguaaga

SEQ ID NO: 2451 - RNA, 19 nt, Artificial Sequence
  Description of Artificial Sequence: Synthetic iRNA agent targeting human EGLN3 oligonucleotide
cuuaccugggaaccuaauu

SEQ ID NO: 2452 - RNA, 19 nt, Artificial Sequence
  Description of Artificial Sequence: Synthetic iRNA agent targeting human EGLN3 oligonucleotide
aauuagguucccagguaag

SEQ ID NO: 2453 - RNA, 19 nt, Artificial Sequence
  Description of Artificial Sequence: Synthetic iRNA agent targeting human EGLN3 oligonucleotide
cugggaaccuaauucccca

SEQ ID NO: 2454 - RNA, 19 nt, Artificial Sequence
  Description of Artificial Sequence: Synthetic iRNA agent targeting human EGLN3 oligonucleotide
uggggaauuagguucccag

SEQ ID NO: 2455 - RNA, 19 nt, Artificial Sequence
  Description of Artificial Sequence: Synthetic iRNA agent targeting human EGLN3 oligonucleotide
gggaaccuaauuccccaga

SEQ ID NO: 2456 - RNA, 19 nt, Artificial Sequence
  Description of Artificial Sequence: Synthetic iRNA agent targeting human EGLN3 oligonucleotide
ucuggggaauuagguuccc

SEQ ID NO: 2457 - RNA, 19 nt, Artificial Sequence
  Description of Artificial Sequence: Synthetic iRNA agent targeting human EGLN3 oligonucleotide
ggaaccuaauuccccagaa

SEQ ID NO: 2458 - RNA, 19 nt, Artificial Sequence
  Description of Artificial Sequence: Synthetic iRNA agent targeting human EGLN3 oligonucleotide
uucuggggaauuagguucc

SEQ ID NO: 2459 - RNA, 19 nt, Artificial Sequence
  Description of Artificial Sequence: Synthetic iRNA agent targeting human EGLN3 oligonucleotide
cuaauuccccagaagcuaa

SEQ ID NO: 2460 - RNA, 19 nt, Artificial Sequence
  Description of Artificial Sequence: Synthetic iRNA agent targeting human EGLN3 oligonucleotide
uuagcuucuggggaauuag

SEQ ID NO: 2461 - RNA, 19 nt, Artificial Sequence
  Description of Artificial Sequence: Synthetic iRNA agent targeting human EGLN3 oligonucleotide
uaauuccccagaagcuaaa

SEQ ID NO: 2462 - RNA, 19 nt, Artificial Sequence
  Description of Artificial Sequence: Synthetic iRNA agent targeting human EGLN3 oligonucleotide
uuuagcuucuggggaauua

SEQ ID NO: 2463 - RNA, 19 nt, Artificial Sequence
  Description of Artificial Sequence: Synthetic iRNA agent targeting human EGLN3 oligonucleotide
aauuccccagaagcuaaaa

SEQ ID NO: 2464 - RNA, 19 nt, Artificial Sequence
  Description of Artificial Sequence: Synthetic iRNA agent targeting human EGLN3 oligonucleotide
uuuuagcuucuggggaauu

SEQ ID NO: 2465 - RNA, 19 nt, Artificial Sequence
  Description of Artificial Sequence: Synthetic iRNA agent targeting human EGLN3 oligonucleotide
auuccccagaagcuaaaaa

SEQ ID NO: 2466 - RNA, 19 nt, Artificial Sequence
  Description of Artificial Sequence: Synthetic iRNA agent targeting human EGLN3 oligonucleotide
uuuuuagcuucuggggaau

SEQ ID NO: 2467 - RNA, 19 nt, Artificial Sequence
  Description of Artificial Sequence: Synthetic iRNA agent targeting human EGLN3 oligonucleotide
ccccagaagcuaaaaaacu

SEQ ID NO: 2468 - RNA, 19 nt, Artificial Sequence
  Description of Artificial Sequence: Synthetic iRNA agent targeting human EGLN3 oligonucleotide
aguuuuuuagcuucugggg

SEQ ID NO: 2469 - RNA, 19 nt, Artificial Sequence
  Description of Artificial Sequence: Synthetic iRNA agent targeting human EGLN3 oligonucleotide
cccagaagcuaaaaaacua

SEQ ID NO: 2470 - RNA, 19 nt, Artificial Sequence
  Description of Artificial Sequence: Synthetic iRNA agent targeting human EGLN3 oligonucleotide
uaguuuuuuagcuucuggg

SEQ ID NO: 2471 - RNA, 19 nt, Artificial Sequence
  Description of Artificial Sequence: Synthetic iRNA agent targeting human EGLN3 oligonucleotide
aaaacuagacauuaguugu

SEQ ID NO: 2472 - RNA, 19 nt, Artificial Sequence
  Description of Artificial Sequence: Synthetic iRNA agent targeting human EGLN3 oligonucleotide
acaacuaaugucuaguuuu

SEQ ID NO: 2473 - RNA, 19 nt, Artificial Sequence
  Description of Artificial Sequence: Synthetic iRNA agent targeting human EGLN3 oligonucleotide
aaacuagacauuaguuguu

SEQ ID NO: 2474 - RNA, 19 nt, Artificial Sequence
  Description of Artificial Sequence: Synthetic iRNA agent targeting human EGLN3 oligonucleotide
aacaacuaaugucuaguuu

SEQ ID NO: 2475 - RNA, 19 nt, Artificial Sequence
  Description of Artificial Sequence: Synthetic iRNA agent targeting human EGLN3 oligonucleotide
aacuagacauuaguuguuu

SEQ ID NO: 2476 - RNA, 19 nt, Artificial Sequence
  Description of Artificial Sequence: Synthetic iRNA agent targeting human EGLN3 oligonucleotide
aaacaacuaaugucuaguu

SEQ ID NO: 2477 - RNA, 19 nt, Artificial Sequence
  Description of Artificial Sequence: Synthetic iRNA agent targeting human EGLN3 oligonucleotide
acuagacauuaguuguuuu

SEQ ID NO: 2478 - RNA, 19 nt, Artificial Sequence
  Description of Artificial Sequence: Synthetic iRNA agent targeting human EGLN3 oligonucleotide
aaaacaacuaaugucuagu

SEQ ID NO: 2479 - RNA, 19 nt, Artificial Sequence
  Description of Artificial Sequence: Synthetic iRNA agent targeting human EGLN3 oligonucleotide
agacauuaguuguuuuggu

SEQ ID NO: 2480 - RNA, 19 nt, Artificial Sequence
  Description of Artificial Sequence: Synthetic iRNA agent targeting human EGLN3 oligonucleotide
accaaaacaacuaaugucu

SEQ ID NO: 2481 - RNA, 19 nt, Artificial Sequence
  Description of Artificial Sequence: Synthetic iRNA agent targeting human EGLN3 oligonucleotide
gacauuaguuguuuugguu

SEQ ID NO: 2482 - RNA, 19 nt, Artificial Sequence
  Description of Artificial Sequence: Synthetic iRNA agent targeting human EGLN3 oligonucleotide
aaccaaaacaacuaauguc

SEQ ID NO: 2483 - RNA, 19 nt, Artificial Sequence
  Description of Artificial Sequence: Synthetic iRNA agent targeting human EGLN3 oligonucleotide
uaguuguuuugguugcuuu

SEQ ID NO: 2484 - RNA, 19 nt, Artificial Sequence
  Description of Artificial Sequence: Synthetic iRNA agent targeting human EGLN3 oligonucleotide
aaagcaaccaaaacaacua

SEQ ID NO: 2485 - RNA, 19 nt, Artificial Sequence
  Description of Artificial Sequence: Synthetic iRNA agent targeting human EGLN3 oligonucleotide
uuguuuugguugcuuuguu

SEQ ID NO: 2486 - RNA, 19 nt, Artificial Sequence
  Description of Artificial Sequence: Synthetic iRNA agent targeting human EGLN3 oligonucleotide
aacaaagcaaccaaaacaa

SEQ ID NO: 2487 - RNA, 19 nt, Artificial Sequence
  Description of Artificial Sequence: Synthetic iRNA agent targeting human EGLN3 oligonucleotide
auaucccugguaguuuugu

SEQ ID NO: 2488 - RNA, 19 nt, Artificial Sequence
  Description of Artificial Sequence: Synthetic iRNA agent targeting human EGLN3 oligonucleotide
acaaaacuaccagggauau

SEQ ID NO: 2489 - RNA, 19 nt, Artificial Sequence
  Description of Artificial Sequence: Synthetic iRNA agent targeting human EGLN3 oligonucleotide
ucccugguaguuuuguguu

SEQ ID NO: 2490 - RNA, 19 nt, Artificial Sequence
  Description of Artificial Sequence: Synthetic iRNA agent targeting human EGLN3 oligonucleotide
aacacaaaacuaccaggga

SEQ ID NO: 2491 - RNA, 19 nt, Artificial Sequence
  Description of Artificial Sequence: Synthetic iRNA agent targeting human EGLN3 oligonucleotide
ccugguaguuuuguguuaa

SEQ ID NO: 2492 - RNA, 19 nt, Artificial Sequence
  Description of Artificial Sequence: Synthetic iRNA agent targeting human EGLN3 oligonucleotide
uuaacacaaaacuaccagg

SEQ ID NO: 2493 - RNA, 19 nt, Artificial Sequence
  Description of Artificial Sequence: Synthetic iRNA agent targeting human EGLN3 oligonucleotide
uaguuuuguguuaaccacu

SEQ ID NO: 2494 - RNA, 19 nt, Artificial Sequence
  Description of Artificial Sequence: Synthetic iRNA agent targeting human EGLN3 oligonucleotide
agugguuaacacaaaacua

SEQ ID NO: 2495 - RNA, 19 nt, Artificial Sequence
  Description of Artificial Sequence: Synthetic iRNA agent targeting human EGLN3 oligonucleotide
guguuaaccacugauaacu

SEQ ID NO: 2496 - RNA, 19 nt, Artificial Sequence
  Description of Artificial Sequence: Synthetic iRNA agent targeting human EGLN3 oligonucleotide
aguuaucagugguuaacac

SEQ ID NO: 2497 - RNA, 19 nt, Artificial Sequence
  Description of Artificial Sequence: Synthetic iRNA agent targeting human EGLN3 oligonucleotide
guuaaccacugauaacugu

SEQ ID NO: 2498 - RNA, 19 nt, Artificial Sequence
  Description of Artificial Sequence: Synthetic iRNA agent targeting human EGLN3 oligonucleotide
acaguuaucagugguuaac

SEQ ID NO: 2499 - RNA, 19 nt, Artificial Sequence
  Description of Artificial Sequence: Synthetic iRNA agent targeting human EGLN3 oligonucleotide
ccacugauaacuguggaaa

SEQ ID NO: 2500 - RNA, 19 nt, Artificial Sequence
  Description of Artificial Sequence: Synthetic iRNA agent targeting human EGLN3 oligonucleotide
uuuccacaguuaucagugg

SEQ ID NO: 2501 - RNA, 19 nt, Artificial Sequence
  Description of Artificial Sequence: Synthetic iRNA agent targeting human EGLN3 oligonucleotide
acugauaacuguggaaaga

SEQ ID NO: 2502 - RNA, 19 nt, Artificial Sequence
  Description of Artificial Sequence: Synthetic iRNA agent targeting human EGLN3 oligonucleotide
ucuuuccacaguuaucagu

SEQ ID NO: 2503 - RNA, 19 nt, Artificial Sequence
  Description of Artificial Sequence: Synthetic iRNA agent targeting human EGLN3 oligonucleotide
ggaaagagcuaggucuacu

SEQ ID NO: 2504 - RNA, 19 nt, Artificial Sequence
  Description of Artificial Sequence: Synthetic iRNA agent targeting human EGLN3 oligonucleotide
aguagaccuagcucuuucc

SEQ ID NO: 2505 - RNA, 19 nt, Artificial Sequence
  Description of Artificial Sequence: Synthetic iRNA agent targeting human EGLN3 oligonucleotide
agcuaggucuacugauaua

SEQ ID NO: 2506 - RNA, 19 nt, Artificial Sequence
  Description of Artificial Sequence: Synthetic iRNA agent targeting human EGLN3 oligonucleotide
uauaucaguagaccuagcu

SEQ ID NO: 2507 - RNA, 19 nt, Artificial Sequence
  Description of Artificial Sequence: Synthetic iRNA agent targeting human EGLN3 oligonucleotide
cuaggucuacugauauaca

SEQ ID NO: 2508 - RNA, 19 nt, Artificial Sequence
  Description of Artificial Sequence: Synthetic iRNA agent targeting human EGLN3 oligonucleotide
uguauaucaguagaccuag

SEQ ID NO: 2509 - RNA, 19 nt, Artificial Sequence
  Description of Artificial Sequence: Synthetic iRNA agent targeting human EGLN3 oligonucleotide
ggucuacugauauacaaua

SEQ ID NO: 2510 - RNA, 19 nt, Artificial Sequence
  Description of Artificial Sequence: Synthetic iRNA agent targeting human EGLN3 oligonucleotide
uauuguauaucaguagacc

SEQ ID NO: 2511 - RNA, 19 nt, Artificial Sequence
  Description of Artificial Sequence: Synthetic iRNA agent targeting human EGLN3 oligonucleotide
gucuacugauauacaauaa

SEQ ID NO: 2512 - RNA, 19 nt, Artificial Sequence
  Description of Artificial Sequence: Synthetic iRNA agent targeting human EGLN3 oligonucleotide
uuauuguauaucaguagac

SEQ ID NO: 2513 - RNA, 19 nt, Artificial Sequence
  Description of Artificial Sequence: Synthetic iRNA agent targeting human EGLN3 oligonucleotide
ucuacugauauacaauaaa

SEQ ID NO: 2514 - RNA, 19 nt, Artificial Sequence
  Description of Artificial Sequence: Synthetic iRNA agent targeting human EGLN3 oligonucleotide
uuuauuguauaucaguaga

SEQ ID NO: 2515 - RNA, 19 nt, Artificial Sequence
  Description of Artificial Sequence: Synthetic iRNA agent targeting human EGLN3 oligonucleotide
uacugauauacaauaaaca

SEQ ID NO: 2516 - RNA, 19 nt, Artificial Sequence
  Description of Artificial Sequence: Synthetic iRNA agent targeting human EGLN3 oligonucleotide
uguuuauuguauaucagua

SEQ ID NO: 2517 - RNA, 19 nt, Artificial Sequence
  Description of Artificial Sequence: Synthetic iRNA agent targeting human EGLN3 oligonucleotide
uacaauaaacaugugugca

SEQ ID NO: 2518 - RNA, 19 nt, Artificial Sequence
  Description of Artificial Sequence: Synthetic iRNA agent targeting human EGLN3 oligonucleotide
ugcacacauguuuauugua

SEQ ID NO: 2519 - RNA, 19 nt, Artificial Sequence
  Description of Artificial Sequence: Synthetic iRNA agent targeting human EGLN3 oligonucleotide
aaacaugugugcaucuuga

SEQ ID NO: 2520 - RNA, 19 nt, Artificial Sequence
  Description of Artificial Sequence: Synthetic iRNA agent targeting human EGLN3 oligonucleotide
ucaagaugcacacauguuu

SEQ ID NO: 2521 - RNA, 19 nt, Artificial Sequence
  Description of Artificial Sequence: Synthetic iRNA agent targeting human EGLN3 oligonucleotide
augugugcaucuugaacaa

SEQ ID NO: 2522 - RNA, 19 nt, Artificial Sequence
  Description of Artificial Sequence: Synthetic iRNA agent targeting human EGLN3 oligonucleotide
uuguucaagaugcacacau

SEQ ID NO: 2523 - RNA, 19 nt, Artificial Sequence
  Description of Artificial Sequence: Synthetic iRNA agent targeting human EGLN3 oligonucleotide
ugugugcaucuugaacaau

SEQ ID NO: 2524 - RNA, 19 nt, Artificial Sequence
  Description of Artificial Sequence: Synthetic iRNA agent targeting human EGLN3 oligonucleotide
auuguucaagaugcacaca

SEQ ID NO: 2525 - RNA, 19 nt, Artificial Sequence
  Description of Artificial Sequence: Synthetic iRNA agent targeting human EGLN3 oligonucleotide
gugugcaucuugaacaauu

SEQ ID NO: 2526 - RNA, 19 nt, Artificial Sequence
  Description of Artificial Sequence: Synthetic iRNA agent targeting human EGLN3 oligonucleotide
aauuguucaagaugcacac

SEQ ID NO: 2527 - RNA, 19 nt, Artificial Sequence
  Description of Artificial Sequence: Synthetic iRNA agent targeting human EGLN3 oligonucleotide
caucuugaacaauuugaga

SEQ ID NO: 2528 - RNA, 19 nt, Artificial Sequence
  Description of Artificial Sequence: Synthetic iRNA agent targeting human EGLN3 oligonucleotide
ucucaaauuguucaagaug

SEQ ID NO: 2529 - RNA, 19 nt, Artificial Sequence
  Description of Artificial Sequence: Synthetic iRNA agent targeting human EGLN3 oligonucleotide
ugaacaauuugagagggga

SEQ ID NO: 2530 - RNA, 19 nt, Artificial Sequence
  Description of Artificial Sequence: Synthetic iRNA agent targeting human EGLN3 oligonucleotide
uccccucucaaauuguuca

SEQ ID NO: 2531 - RNA, 19 nt, Artificial Sequence
  Description of Artificial Sequence: Synthetic iRNA agent targeting human EGLN3 oligonucleotide
acaauuugagaggggaggu

SEQ ID NO: 2532 - RNA, 19 nt, Artificial Sequence
  Description of Artificial Sequence: Synthetic iRNA agent targeting human EGLN3 oligonucleotide
accuccccucucaaauugu

SEQ ID NO: 2533 - RNA, 19 nt, Artificial Sequence
  Description of Artificial Sequence: Synthetic iRNA agent targeting human EGLN3 oligonucleotide
uggaaauguggguguuccu

SEQ ID NO: 2534 - RNA, 19 nt, Artificial Sequence
  Description of Artificial Sequence: Synthetic iRNA agent targeting human EGLN3 oligonucleotide
aggaacacccacauuucca

SEQ ID NO: 2535 - RNA, 19 nt, Artificial Sequence
  Description of Artificial Sequence: Synthetic iRNA agent targeting human EGLN3 oligonucleotide
aauguggguguuccuguuu

SEQ ID NO: 2536 - RNA, 19 nt, Artificial Sequence
  Description of Artificial Sequence: Synthetic iRNA agent targeting human EGLN3 oligonucleotide
aaacaggaacacccacauu

SEQ ID NO: 2537 - RNA, 19 nt, Artificial Sequence
  Description of Artificial Sequence: Synthetic iRNA agent targeting human EGLN3 oligonucleotide
uggguguuccuguuuuuuu

SEQ ID NO: 2538 - RNA, 19 nt, Artificial Sequence
  Description of Artificial Sequence: Synthetic iRNA agent targeting human EGLN3 oligonucleotide
aaaaaaacaggaacaccca

SEQ ID NO: 2539 - RNA, 19 nt, Artificial Sequence
  Description of Artificial Sequence: Synthetic iRNA agent targeting human EGLN3 oligonucleotide
uuaaugagcucacccuuua

SEQ ID NO: 2540 - RNA, 19 nt, Artificial Sequence
  Description of Artificial Sequence: Synthetic iRNA agent targeting human EGLN3 oligonucleotide
uaaagggugagcucauuaa

SEQ ID NO: 2541 - RNA, 19 nt, Artificial Sequence
  Description of Artificial Sequence: Synthetic iRNA agent targeting human EGLN3 oligonucleotide
uaaugagcucacccuuuaa

SEQ ID NO: 2542 - RNA, 19 nt, Artificial Sequence
  Description of Artificial Sequence: Synthetic iRNA agent targeting human EGLN3 oligonucleotide
uuaaagggugagcucauua

SEQ ID NO: 2543 - RNA, 19 nt, Artificial Sequence
  Description of Artificial Sequence: Synthetic iRNA agent targeting human EGLN3 oligonucleotide
augagcucacccuuuaaca

SEQ ID NO: 2544 - RNA, 19 nt, Artificial Sequence
  Description of Artificial Sequence: Synthetic iRNA agent targeting human EGLN3 oligonucleotide
uguuaaagggugagcucau

SEQ ID NO: 2545 - RNA, 19 nt, Artificial Sequence
  Description of Artificial Sequence: Synthetic iRNA agent targeting human EGLN3 oligonucleotide
gagcucacccuuuaacaca

SEQ ID NO: 2546 - RNA, 19 nt, Artificial Sequence
  Description of Artificial Sequence: Synthetic iRNA agent targeting human EGLN3 oligonucleotide
uguguuaaagggugagcuc

SEQ ID NO: 2547 - RNA, 19 nt, Artificial Sequence
  Description of Artificial Sequence: Synthetic iRNA agent targeting human EGLN3 oligonucleotide
gcucacccuuuaacacaaa

SEQ ID NO: 2548 - RNA, 19 nt, Artificial Sequence
  Description of Artificial Sequence: Synthetic iRNA agent targeting human EGLN3 oligonucleotide
uuuguguuaaagggugagc

SEQ ID NO: 2549 - RNA, 19 nt, Artificial Sequence
  Description of Artificial Sequence: Synthetic iRNA agent targeting human EGLN3 oligonucleotide
ucacccuuuaacacaaaaa

SEQ ID NO: 2550 - RNA, 19 nt, Artificial Sequence
  Description of Artificial Sequence: Synthetic iRNA agent targeting human EGLN3 oligonucleotide
uuuuuguguuaaaggguga

SEQ ID NO: 2551 - RNA, 19 nt, Artificial Sequence
  Description of Artificial Sequence: Synthetic iRNA agent targeting human EGLN3 oligonucleotide
cacccuuuaacacaaaaaa

SEQ ID NO: 2552 - RNA, 19 nt, Artificial Sequence
  Description of Artificial Sequence: Synthetic iRNA agent targeting human EGLN3 oligonucleotide
uuuuuuguguuaaagggug

SEQ ID NO: 2553 - RNA, 19 nt, Artificial Sequence
  Description of Artificial Sequence: Synthetic iRNA agent targeting human EGLN3 oligonucleotide
cuuuaacacaaaaaaagca

SEQ ID NO: 2554 - RNA, 19 nt, Artificial Sequence
  Description of Artificial Sequence: Synthetic iRNA agent targeting human EGLN3 oligonucleotide
ugcuuuuuuuguguuaaag

SEQ ID NO: 2555 - RNA, 19 nt, Artificial Sequence
  Description of Artificial Sequence: Synthetic iRNA agent targeting human EGLN3 oligonucleotide
acaaaaaaagcaaggugau

SEQ ID NO: 2556 - RNA, 19 nt, Artificial Sequence
  Description of Artificial Sequence: Synthetic iRNA agent targeting human EGLN3 oligonucleotide
aucaccuugcuuuuuuugu

SEQ ID NO: 2557 - RNA, 19 nt, Artificial Sequence
  Description of Artificial Sequence: Synthetic iRNA agent targeting human EGLN3 oligonucleotide
gauguauuuuaaaaaagga

SEQ ID NO: 2558 - RNA, 19 nt, Artificial Sequence
  Description of Artificial Sequence: Synthetic iRNA agent targeting human EGLN3 oligonucleotide
uccuuuuuuaaaauacauc

SEQ ID NO: 2559 - RNA, 19 nt, Artificial Sequence
  Description of Artificial Sequence: Synthetic iRNA agent targeting human EGLN3 oligonucleotide
ggaaguggaaauaaaaaaa

SEQ ID NO: 2560 - RNA, 19 nt, Artificial Sequence
  Description of Artificial Sequence: Synthetic iRNA agent targeting human EGLN3 oligonucleotide
uuuuuuuauuuccacuucc

SEQ ID NO: 2561 - RNA, 19 nt, Artificial Sequence
  Description of Artificial Sequence: Synthetic iRNA agent targeting human EGLN3 oligonucleotide
aaaaaaaucucaaagcuau

SEQ ID NO: 2562 - RNA, 19 nt, Artificial Sequence
  Description of Artificial Sequence: Synthetic iRNA agent targeting human EGLN3 oligonucleotide
auagcuuugagauuuuuuu

SEQ ID NO: 2563 - RNA, 19 nt, Artificial Sequence
  Description of Artificial Sequence: Synthetic iRNA agent targeting human EGLN3 oligonucleotide
aaaaaaucucaaagcuauu

SEQ ID NO: 2564 - RNA, 19 nt, Artificial Sequence
  Description of Artificial Sequence: Synthetic iRNA agent targeting human EGLN3 oligonucleotide
aauagcuuugagauuuuuu

SEQ ID NO: 2565 - RNA, 19 nt, Artificial Sequence
  Description of Artificial Sequence: Synthetic iRNA agent targeting human EGLN3 oligonucleotide
ucaaagcuauuugaguucu

SEQ ID NO: 2566 - RNA, 19 nt, Artificial Sequence
  Description of Artificial Sequence: Synthetic iRNA agent targeting human EGLN3 oligonucleotide
agaacucaaauagcuuuga

SEQ ID NO: 2567 - RNA, 19 nt, Artificial Sequence
  Description of Artificial Sequence: Synthetic iRNA agent targeting human EGLN3 oligonucleotide
aagcuauuugaguucucgu

SEQ ID NO: 2568 - RNA, 19 nt, Artificial Sequence
  Description of Artificial Sequence: Synthetic iRNA agent targeting human EGLN3 oligonucleotide
acgagaacucaaauagcuu

SEQ ID NO: 2569 - RNA, 19 nt, Artificial Sequence
  Description of Artificial Sequence: Synthetic iRNA agent targeting human EGLN3 oligonucleotide
gcuauuugaguucucgucu

SEQ ID NO: 2570 - RNA, 19 nt, Artificial Sequence
  Description of Artificial Sequence: Synthetic iRNA agent targeting human EGLN3 oligonucleotide
agacgagaacucaaauagc

SEQ ID NO: 2571 - RNA, 19 nt, Artificial Sequence
  Description of Artificial Sequence: Synthetic iRNA agent targeting human EGLN3 oligonucleotide
cucgucugucccuagcagu

SEQ ID NO: 2572 - RNA, 19 nt, Artificial Sequence
  Description of Artificial Sequence: Synthetic iRNA agent targeting human EGLN3 oligonucleotide
acugcuagggacagacgag

SEQ ID NO: 2573 - RNA, 19 nt, Artificial Sequence
  Description of Artificial Sequence: Synthetic iRNA agent targeting human EGLN3 oligonucleotide
cgucugucccuagcagucu

SEQ ID NO: 2574 - RNA, 19 nt, Artificial Sequence
  Description of Artificial Sequence: Synthetic iRNA agent targeting human EGLN3 oligonucleotide
agacugcuagggacagacg

SEQ ID NO: 2575 - RNA, 19 nt, Artificial Sequence
  Description of Artificial Sequence: Synthetic iRNA agent targeting human EGLN3 oligonucleotide
gucccuagcagucuuucuu

SEQ ID NO: 2576 - RNA, 19 nt, Artificial Sequence
  Description of Artificial Sequence: Synthetic iRNA agent targeting human EGLN3 oligonucleotide
aagaaagacugcuagggac

SEQ ID NO: 2577 - RNA, 19 nt, Artificial Sequence
  Description of Artificial Sequence: Synthetic iRNA agent targeting human EGLN3 oligonucleotide
cuucagcucacuuggcucu

SEQ ID NO: 2578 - RNA, 19 nt, Artificial Sequence
  Description of Artificial Sequence: Synthetic iRNA agent targeting human EGLN3 oligonucleotide
agagccaagugagcugaag

SEQ ID NO: 2579 - RNA, 19 nt, Artificial Sequence
  Description of Artificial Sequence: Synthetic iRNA agent targeting human EGLN3 oligonucleotide
ucagcucacuuggcucucu

SEQ ID NO: 2580 - RNA, 19 nt, Artificial Sequence
  Description of Artificial Sequence: Synthetic iRNA agent targeting human EGLN3 oligonucleotide
agagagccaagugagcuga

SEQ ID NO: 2581 - RNA, 19 nt, Artificial Sequence
  Description of Artificial Sequence: Synthetic iRNA agent targeting human EGLN3 oligonucleotide
cagcucacuuggcucucua

SEQ ID NO: 2582 - RNA, 19 nt, Artificial Sequence
  Description of Artificial Sequence: Synthetic iRNA agent targeting human EGLN3 oligonucleotide
uagagagccaagugagcug

SEQ ID NO: 2583 - RNA, 19 nt, Artificial Sequence
  Description of Artificial Sequence: Synthetic iRNA agent targeting human EGLN3 oligonucleotide
uuggcucucuagauccacu

SEQ ID NO: 2584 - RNA, 19 nt, Artificial Sequence
  Description of Artificial Sequence: Synthetic iRNA agent targeting human EGLN3 oligonucleotide
aguggaucuagagagccaa

SEQ ID NO: 2585 - RNA, 19 nt, Artificial Sequence
  Description of Artificial Sequence: Synthetic iRNA agent targeting human EGLN3 oligonucleotide
ggcucucuagauccacugu

SEQ ID NO: 2586 - RNA, 19 nt, Artificial Sequence
  Description of Artificial Sequence: Synthetic iRNA agent targeting human EGLN3 oligonucleotide
acaguggaucuagagagcc

SEQ ID NO: 2587 - RNA, 19 nt, Artificial Sequence
  Description of Artificial Sequence: Synthetic iRNA agent targeting human EGLN3 oligonucleotide
ucucuagauccacuguggu

SEQ ID NO: 2588 - RNA, 19 nt, Artificial Sequence
  Description of Artificial Sequence: Synthetic iRNA agent targeting human EGLN3 oligonucleotide
accacaguggaucuagaga

SEQ ID NO: 2589 - RNA, 19 nt, Artificial Sequence
  Description of Artificial Sequence: Synthetic iRNA agent targeting human EGLN3 oligonucleotide
agauccacugugguuggca

SEQ ID NO: 2590 - RNA, 19 nt, Artificial Sequence
  Description of Artificial Sequence: Synthetic iRNA agent targeting human EGLN3 oligonucleotide
ugccaaccacaguggaucu

SEQ ID NO: 2591 - RNA, 19 nt, Artificial Sequence
  Description of Artificial Sequence: Synthetic iRNA agent targeting human EGLN3 oligonucleotide
auccacugugguuggcagu

SEQ ID NO: 2592 - RNA, 19 nt, Artificial Sequence
  Description of Artificial Sequence: Synthetic iRNA agent targeting human EGLN3 oligonucleotide
acugccaaccacaguggau

SEQ ID NO: 2593 - RNA, 19 nt, Artificial Sequence
  Description of Artificial Sequence: Synthetic iRNA agent targeting human EGLN3 oligonucleotide
uccacugugguuggcagua

SEQ ID NO: 2594 - RNA, 19 nt, Artificial Sequence
  Description of Artificial Sequence: Synthetic iRNA agent targeting human EGLN3 oligonucleotide
uacugccaaccacagugga

SEQ ID NO: 2595 - RNA, 19 nt, Artificial Sequence
  Description of Artificial Sequence: Synthetic iRNA agent targeting human EGLN3 oligonucleotide
ccacugugguuggcaguau

SEQ ID NO: 2596 - RNA, 19 nt, Artificial Sequence
  Description of Artificial Sequence: Synthetic iRNA agent targeting human EGLN3 oligonucleotide
auacugccaaccacagugg

SEQ ID NO: 2597 - RNA, 19 nt, Artificial Sequence
  Description of Artificial Sequence: Synthetic iRNA agent targeting human EGLN3 oligonucleotide
uuggcaguaugaccagaau

SEQ ID NO: 2598 - RNA, 19 nt, Artificial Sequence
  Description of Artificial Sequence: Synthetic iRNA agent targeting human EGLN3 oligonucleotide
auucuggucauacugccaa

SEQ ID NO: 2599 - RNA, 19 nt, Artificial Sequence
  Description of Artificial Sequence: Synthetic iRNA agent targeting human EGLN3 oligonucleotide
ggcaguaugaccagaauca

SEQ ID NO: 2600 - RNA, 19 nt, Artificial Sequence
  Description of Artificial Sequence: Synthetic iRNA agent targeting human EGLN3 oligonucleotide
ugauucuggucauacugcc

SEQ ID NO: 2601 - RNA, 19 nt, Artificial Sequence
  Description of Artificial Sequence: Synthetic iRNA agent targeting human EGLN3 oligonucleotide
guaugaccagaaucaugga

SEQ ID NO: 2602 - RNA, 19 nt, Artificial Sequence
  Description of Artificial Sequence: Synthetic iRNA agent targeting human EGLN3 oligonucleotide
uccaugauucuggucauac

SEQ ID NO: 2603 - RNA, 19 nt, Artificial Sequence
  Description of Artificial Sequence: Synthetic iRNA agent targeting human EGLN3 oligonucleotide
aaucauggaauuugcuaga

SEQ ID NO: 2604 - RNA, 19 nt, Artificial Sequence
  Description of Artificial Sequence: Synthetic iRNA agent targeting human EGLN3 oligonucleotide
ucuagcaaauuccaugauu

SEQ ID NO: 2605 - RNA, 19 nt, Artificial Sequence
  Description of Artificial Sequence: Synthetic iRNA agent targeting human EGLN3 oligonucleotide
aucauggaauuugcuagaa

SEQ ID NO: 2606 - RNA, 19 nt, Artificial Sequence
  Description of Artificial Sequence: Synthetic iRNA agent targeting human EGLN3 oligonucleotide
uucuagcaaauuccaugau

SEQ ID NO: 2607 - RNA, 19 nt, Artificial Sequence
  Description of Artificial Sequence: Synthetic iRNA agent targeting human EGLN3 oligonucleotide
uggaauuugcuagaacugu

SEQ ID NO: 2608 - RNA, 19 nt, Artificial Sequence
  Description of Artificial Sequence: Synthetic iRNA agent targeting human EGLN3 oligonucleotide
acaguucuagcaaauucca

SEQ ID NO: 2609 - RNA, 19 nt, Artificial Sequence
  Description of Artificial Sequence: Synthetic iRNA agent targeting human EGLN3 oligonucleotide
auuugcuagaacuguggaa

SEQ ID NO: 2610 - RNA, 19 nt, Artificial Sequence
  Description of Artificial Sequence: Synthetic iRNA agent targeting human EGLN3 oligonucleotide
uuccacaguucuagcaaau

SEQ ID NO: 2611 - RNA, 19 nt, Artificial Sequence
  Description of Artificial Sequence: Synthetic iRNA agent targeting human EGLN3 oligonucleotide
gcuagaacuguggaagcuu

SEQ ID NO: 2612 - RNA, 19 nt, Artificial Sequence
  Description of Artificial Sequence: Synthetic iRNA agent targeting human EGLN3 oligonucleotide
aagcuuccacaguucuagc

SEQ ID NO: 2613 - RNA, 19 nt, Artificial Sequence
  Description of Artificial Sequence: Synthetic iRNA agent targeting human EGLN3 oligonucleotide
agcuucuacuccugcagua

SEQ ID NO: 2614 - RNA, 19 nt, Artificial Sequence
  Description of Artificial Sequence: Synthetic iRNA agent targeting human EGLN3 oligonucleotide
uacugcaggaguagaagcu

SEQ ID NO: 2615 - RNA, 19 nt, Artificial Sequence
  Description of Artificial Sequence: Synthetic iRNA agent targeting human EGLN3 oligonucleotide
gcuucuacuccugcaguaa

SEQ ID NO: 2616 - RNA, 19 nt, Artificial Sequence
  Description of Artificial Sequence: Synthetic iRNA agent targeting human EGLN3 oligonucleotide
uuacugcaggaguagaagc

SEQ ID NO: 2617 - RNA, 19 nt, Artificial Sequence
  Description of Artificial Sequence: Synthetic iRNA agent targeting human EGLN3 oligonucleotide
cuccugcaguaagcacaga

SEQ ID NO: 2618 - RNA, 19 nt, Artificial Sequence
  Description of Artificial Sequence: Synthetic iRNA agent targeting human EGLN3 oligonucleotide
ucugugcuuacugcaggag

SEQ ID NO: 2619 - RNA, 19 nt, Artificial Sequence
  Description of Artificial Sequence: Synthetic iRNA agent targeting human EGLN3 oligonucleotide
agcacagaucgcacugccu

SEQ ID NO: 2620 - RNA, 19 nt, Artificial Sequence
  Description of Artificial Sequence: Synthetic iRNA agent targeting human EGLN3 oligonucleotide
aggcagugcgaucugugcu

SEQ ID NO: 2621 - RNA, 19 nt, Artificial Sequence
  Description of Artificial Sequence: Synthetic iRNA agent targeting human EGLN3 oligonucleotide
acagaucgcacugccucaa

SEQ ID NO: 2622 - RNA, 19 nt, Artificial Sequence
  Description of Artificial Sequence: Synthetic iRNA agent targeting human EGLN3 oligonucleotide
uugaggcagugcgaucugu

SEQ ID NO: 2623 - RNA, 19 nt, Artificial Sequence
  Description of Artificial Sequence: Synthetic iRNA agent targeting human EGLN3 oligonucleotide
cagaucgcacugccucaau

SEQ ID NO: 2624 - RNA, 19 nt, Artificial Sequence
  Description of Artificial Sequence: Synthetic iRNA agent targeting human EGLN3 oligonucleotide
auugaggcagugcgaucug

SEQ ID NO: 2625 - RNA, 19 nt, Artificial Sequence
  Description of Artificial Sequence: Synthetic iRNA agent targeting human EGLN3 oligonucleotide
agaucgcacugccucaaua

SEQ ID NO: 2626 - RNA, 19 nt, Artificial Sequence
  Description of Artificial Sequence: Synthetic iRNA agent targeting human EGLN3 oligonucleotide
uauugaggcagugcgaucu

SEQ ID NO: 2627 - RNA, 19 nt, Artificial Sequence
  Description of Artificial Sequence: Synthetic iRNA agent targeting human EGLN3 oligonucleotide
gaucgcacugccucaauaa

SEQ ID NO: 2628 - RNA, 19 nt, Artificial Sequence
  Description of Artificial Sequence: Synthetic iRNA agent targeting human EGLN3 oligonucleotide
uuauugaggcagugcgauc

SEQ ID NO: 2629 - RNA, 19 nt, Artificial Sequence
  Description of Artificial Sequence: Synthetic iRNA agent targeting human EGLN3 oligonucleotide
acugccucaauaacuuggu

SEQ ID NO: 2630 - RNA, 19 nt, Artificial Sequence
  Description of Artificial Sequence: Synthetic iRNA agent targeting human EGLN3 oligonucleotide
accaaguuauugaggcagu

SEQ ID NO: 2631 - RNA, 19 nt, Artificial Sequence
  Description of Artificial Sequence: Synthetic iRNA agent targeting human EGLN3 oligonucleotide
ugccucaauaacuugguau

SEQ ID NO: 2632 - RNA, 19 nt, Artificial Sequence
  Description of Artificial Sequence: Synthetic iRNA agent targeting human EGLN3 oligonucleotide
auaccaaguuauugaggca

SEQ ID NO: 2633 - RNA, 19 nt, Artificial Sequence
  Description of Artificial Sequence: Synthetic iRNA agent targeting human EGLN3 oligonucleotide
aauaacuugguauugagca

SEQ ID NO: 2634 - RNA, 19 nt, Artificial Sequence
  Description of Artificial Sequence: Synthetic iRNA agent targeting human EGLN3 oligonucleotide
ugcucaauaccaaguuauu

SEQ ID NO: 2635 - RNA, 19 nt, Artificial Sequence
  Description of Artificial Sequence: Synthetic iRNA agent targeting human EGLN3 oligonucleotide
aacuugguauugagcacgu

SEQ ID NO: 2636 - RNA, 19 nt, Artificial Sequence
  Description of Artificial Sequence: Synthetic iRNA agent targeting human EGLN3 oligonucleotide
acgugcucaauaccaaguu

SEQ ID NO: 2637 - RNA, 19 nt, Artificial Sequence
  Description of Artificial Sequence: Synthetic iRNA agent targeting human EGLN3 oligonucleotide
uugguauugagcacguauu

SEQ ID NO: 2638 - RNA, 19 nt, Artificial Sequence
  Description of Artificial Sequence: Synthetic iRNA agent targeting human EGLN3 oligonucleotide
aauacgugcucaauaccaa

SEQ ID NO: 2639 - RNA, 19 nt, Artificial Sequence
  Description of Artificial Sequence: Synthetic iRNA agent targeting human EGLN3 oligonucleotide
acguauuuugcaaaagcua

SEQ ID NO: 2640 - RNA, 19 nt, Artificial Sequence
  Description of Artificial Sequence: Synthetic iRNA agent targeting human EGLN3 oligonucleotide
uagcuuuugcaaaauacgu

SEQ ID NO: 2641 - RNA, 19 nt, Artificial Sequence
  Description of Artificial Sequence: Synthetic iRNA agent targeting human EGLN3 oligonucleotide
guauuuugcaaaagcuacu

SEQ ID NO: 2642 - RNA, 19 nt, Artificial Sequence
  Description of Artificial Sequence: Synthetic iRNA agent targeting human EGLN3 oligonucleotide
aguagcuuuugcaaaauac

SEQ ID NO: 2643 - RNA, 19 nt, Artificial Sequence
  Description of Artificial Sequence: Synthetic iRNA agent targeting human EGLN3 oligonucleotide
uauuuugcaaaagcuacuu

SEQ ID NO: 2644 - RNA, 19 nt, Artificial Sequence
  Description of Artificial Sequence: Synthetic iRNA agent targeting human EGLN3 oligonucleotide
aaguagcuuuugcaaaaua

SEQ ID NO: 2645 - RNA, 19 nt, Artificial Sequence
  Description of Artificial Sequence: Synthetic iRNA agent targeting human EGLN3 oligonucleotide
auuuugcaaaagcuacuuu

SEQ ID NO: 2646 - RNA, 19 nt, Artificial Sequence
  Description of Artificial Sequence: Synthetic iRNA agent targeting human EGLN3 oligonucleotide
aaaguagcuuuugcaaaau

SEQ ID NO: 2647 - RNA, 19 nt, Artificial Sequence
  Description of Artificial Sequence: Synthetic iRNA agent targeting human EGLN3 oligonucleotide
aagcuacuuuuccuaguuu

SEQ ID NO: 2648 - RNA, 19 nt, Artificial Sequence
  Description of Artificial Sequence: Synthetic iRNA agent targeting human EGLN3 oligonucleotide
aaacuaggaaaaguagcuu

SEQ ID NO: 2649 - RNA, 19 nt, Artificial Sequence
  Description of Artificial Sequence: Synthetic iRNA agent targeting human EGLN3 oligonucleotide
cuacuuuuccuaguuuuca

SEQ ID NO: 2650 - RNA, 19 nt, Artificial Sequence
  Description of Artificial Sequence: Synthetic iRNA agent targeting human EGLN3 oligonucleotide
ugaaaacuaggaaaaguag

SEQ ID NO: 2651 - RNA, 19 nt, Artificial Sequence
  Description of Artificial Sequence: Synthetic iRNA agent targeting human EGLN3 oligonucleotide
ccuaguuuucaguauuacu

SEQ ID NO: 2652 - RNA, 19 nt, Artificial Sequence
  Description of Artificial Sequence: Synthetic iRNA agent targeting human EGLN3 oligonucleotide
aguaauacugaaaacuagg

SEQ ID NO: 2653 - RNA, 19 nt, Artificial Sequence
  Description of Artificial Sequence: Synthetic iRNA agent targeting human EGLN3 oligonucleotide
cuaguuuucaguauuacuu

SEQ ID NO: 2654 - RNA, 19 nt, Artificial Sequence
  Description of Artificial Sequence: Synthetic iRNA agent targeting human EGLN3 oligonucleotide
aaguaauacugaaaacuag

SEQ ID NO: 2655 - RNA, 19 nt, Artificial Sequence
  Description of Artificial Sequence: Synthetic iRNA agent targeting human EGLN3 oligonucleotide
aucccuuuaauuucuugcu

SEQ ID NO: 2656 - RNA, 19 nt, Artificial Sequence
  Description of Artificial Sequence: Synthetic iRNA agent targeting human EGLN3 oligonucleotide
agcaagaaauuaaagggau

SEQ ID NO: 2657 - RNA, 19 nt, Artificial Sequence
  Description of Artificial Sequence: Synthetic iRNA agent targeting human EGLN3 oligonucleotide
uugcuugaaaaucccauga

SEQ ID NO: 2658 - RNA, 19 nt, Artificial Sequence
  Description of Artificial Sequence: Synthetic iRNA agent targeting human EGLN3 oligonucleotide
ucaugggauuuucaagcaa

SEQ ID NO: 2659 - RNA, 19 nt, Artificial Sequence
  Description of Artificial Sequence: Synthetic iRNA agent targeting human EGLN3 oligonucleotide
ugcuugaaaaucccaugaa

SEQ ID NO: 2660 - RNA, 19 nt, Artificial Sequence
  Description of Artificial Sequence: Synthetic iRNA agent targeting human EGLN3 oligonucleotide
uucaugggauuuucaagca

SEQ ID NO: 2661 - RNA, 19 nt, Artificial Sequence
  Description of Artificial Sequence: Synthetic iRNA agent targeting human EGLN3 oligonucleotide
cuugaaaaucccaugaaca

SEQ ID NO: 2662 - RNA, 19 nt, Artificial Sequence
  Description of Artificial Sequence: Synthetic iRNA agent targeting human EGLN3 oligonucleotide
uguucaugggauuuucaag

SEQ ID NO: 2663 - RNA, 19 nt, Artificial Sequence
  Description of Artificial Sequence: Synthetic iRNA agent targeting human EGLN3 oligonucleotide
gaacauuaaagagccagaa

SEQ ID NO: 2664 - RNA, 19 nt, Artificial Sequence
  Description of Artificial Sequence: Synthetic iRNA agent targeting human EGLN3 oligonucleotide
uucuggcucuuuaauguuc

SEQ ID NO: 2665 - RNA, 19 nt, Artificial Sequence
  Description of Artificial Sequence: Synthetic iRNA agent targeting human EGLN3 oligonucleotide
cauuaaagagccagaaaua

SEQ ID NO: 2666 - RNA, 19 nt, Artificial Sequence
  Description of Artificial Sequence: Synthetic iRNA agent targeting human EGLN3 oligonucleotide
uauuucuggcucuuuaaug

SEQ ID NO: 2667 - RNA, 19 nt, Artificial Sequence
  Description of Artificial Sequence: Synthetic iRNA agent targeting human EGLN3 oligonucleotide
gccagaaauauuuuccuuu

SEQ ID NO: 2668 - RNA, 19 nt, Artificial Sequence
  Description of Artificial Sequence: Synthetic iRNA agent targeting human EGLN3 oligonucleotide
aaaggaaaauauuucuggc

SEQ ID NO: 2669 - RNA, 19 nt, Artificial Sequence
  Description of Artificial Sequence: Synthetic iRNA agent targeting human EGLN3 oligonucleotide
uuccuuuguuauguacgga

SEQ ID NO: 2670 - RNA, 19 nt, Artificial Sequence
  Description of Artificial Sequence: Synthetic iRNA agent targeting human EGLN3 oligonucleotide
uccguacauaacaaaggaa

SEQ ID NO: 2671 - RNA, 19 nt, Artificial Sequence
  Description of Artificial Sequence: Synthetic iRNA agent targeting human EGLN3 oligonucleotide
uccuuuguuauguacggau

SEQ ID NO: 2672 - RNA, 19 nt, Artificial Sequence
  Description of Artificial Sequence: Synthetic iRNA agent targeting human EGLN3 oligonucleotide
auccguacauaacaaagga

SEQ ID NO: 2673 - RNA, 19 nt, Artificial Sequence
  Description of Artificial Sequence: Synthetic iRNA agent targeting human EGLN3 oligonucleotide
ccuuuguuauguacggaua

SEQ ID NO: 2674 - RNA, 19 nt, Artificial Sequence
  Description of Artificial Sequence: Synthetic iRNA agent targeting human EGLN3 oligonucleotide
uauccguacauaacaaagg

SEQ ID NO: 2675 - RNA, 19 nt, Artificial Sequence
  Description of Artificial Sequence: Synthetic iRNA agent targeting human EGLN3 oligonucleotide
cuuuguuauguacggauau

SEQ ID NO: 2676 - RNA, 19 nt, Artificial Sequence
  Description of Artificial Sequence: Synthetic iRNA agent targeting human EGLN3 oligonucleotide
auauccguacauaacaaag

SEQ ID NO: 2677 - RNA, 19 nt, Artificial Sequence
  Description of Artificial Sequence: Synthetic iRNA agent targeting human EGLN3 oligonucleotide
uuuguuauguacggauaua

SEQ ID NO: 2678 - RNA, 19 nt, Artificial Sequence
  Description of Artificial Sequence: Synthetic iRNA agent targeting human EGLN3 oligonucleotide
uauauccguacauaacaaa

SEQ ID NO: 2679 - RNA, 19 nt, Artificial Sequence
  Description of Artificial Sequence: Synthetic iRNA agent targeting human EGLN3 oligonucleotide
uuguuauguacggauauau

SEQ ID NO: 2680 - RNA, 19 nt, Artificial Sequence
  Description of Artificial Sequence: Synthetic iRNA agent targeting human EGLN3 oligonucleotide
auauauccguacauaacaa

SEQ ID NO: 2681 - RNA, 19 nt, Artificial Sequence
  Description of Artificial Sequence: Synthetic iRNA agent targeting human EGLN3 oligonucleotide
uguuauguacggauauaua

SEQ ID NO: 2682 - RNA, 19 nt, Artificial Sequence
  Description of Artificial Sequence: Synthetic iRNA agent targeting human EGLN3 oligonucleotide
uauauauccguacauaaca

SEQ ID NO: 2683 - RNA, 19 nt, Artificial Sequence
  Description of Artificial Sequence: Synthetic iRNA agent targeting human EGLN3 oligonucleotide
uauauagucuuccaagaua

SEQ ID NO: 2684 - RNA, 19 nt, Artificial Sequence
  Description of Artificial Sequence: Synthetic iRNA agent targeting human EGLN3 oligonucleotide
uaucuuggaagacuauaua

SEQ ID NO: 2685 - RNA, 19 nt, Artificial Sequence
  Description of Artificial Sequence: Synthetic iRNA agent targeting human EGLN3 oligonucleotide
ucuuccaagauagaaguuu

SEQ ID NO: 2686 - RNA, 19 nt, Artificial Sequence
  Description of Artificial Sequence: Synthetic iRNA agent targeting human EGLN3 oligonucleotide
aaacuucuaucuuggaaga

SEQ ID NO: 2687 - RNA, 19 nt, Artificial Sequence
  Description of Artificial Sequence: Synthetic iRNA agent targeting human EGLN3 oligonucleotide
uccaagauagaaguuuacu

SEQ ID NO: 2688 - RNA, 19 nt, Artificial Sequence
  Description of Artificial Sequence: Synthetic iRNA agent targeting human EGLN3 oligonucleotide
aguaaacuucuaucuugga

SEQ ID NO: 2689 - RNA, 19 nt, Artificial Sequence
  Description of Artificial Sequence: Synthetic iRNA agent targeting human EGLN3 oligonucleotide
ccaagauagaaguuuacuu

SEQ ID NO: 2690 - RNA, 19 nt, Artificial Sequence
  Description of Artificial Sequence: Synthetic iRNA agent targeting human EGLN3 oligonucleotide
aaguaaacuucuaucuugg

SEQ ID NO: 2691 - RNA, 19 nt, Artificial Sequence
  Description of Artificial Sequence: Synthetic iRNA agent targeting human EGLN3 oligonucleotide
uuccagauaagacauguca

SEQ ID NO: 2692 - RNA, 19 nt, Artificial Sequence
  Description of Artificial Sequence: Synthetic iRNA agent targeting human EGLN3 oligonucleotide
ugacaugucuuaucuggaa

SEQ ID NO: 2693 - RNA, 19 nt, Artificial Sequence
  Description of Artificial Sequence: Synthetic iRNA agent targeting human EGLN3 oligonucleotide
auaagacaugucaccauua

SEQ ID NO: 2694 - RNA, 19 nt, Artificial Sequence
  Description of Artificial Sequence: Synthetic iRNA agent targeting human EGLN3 oligonucleotide
uaauggugacaugucuuau

SEQ ID NO: 2695 - RNA, 19 nt, Artificial Sequence
  Description of Artificial Sequence: Synthetic iRNA agent targeting human EGLN3 oligonucleotide
aagacaugucaccauuaau

SEQ ID NO: 2696 - RNA, 19 nt, Artificial Sequence
  Description of Artificial Sequence: Synthetic iRNA agent targeting human EGLN3 oligonucleotide
auuaauggugacaugucuu

SEQ ID NO: 2697 - RNA, 19 nt, Artificial Sequence
  Description of Artificial Sequence: Synthetic iRNA agent targeting human EGLN3 oligonucleotide
acaugucaccauuaauucu

SEQ ID NO: 2698 - RNA, 19 nt, Artificial Sequence
  Description of Artificial Sequence: Synthetic iRNA agent targeting human EGLN3 oligonucleotide
agaauuaauggugacaugu

SEQ ID NO: 2699 - RNA, 19 nt, Artificial Sequence
  Description of Artificial Sequence: Synthetic iRNA agent targeting human EGLN3 oligonucleotide
augucaccauuaauucuca

SEQ ID NO: 2700 - RNA, 19 nt, Artificial Sequence
  Description of Artificial Sequence: Synthetic iRNA agent targeting human EGLN3 oligonucleotide
ugagaauuaauggugacau

SEQ ID NO: 2701 - RNA, 19 nt, Artificial Sequence
  Description of Artificial Sequence: Synthetic iRNA agent targeting human EGLN3 oligonucleotide
ugucaccauuaauucucaa

SEQ ID NO: 2702 - RNA, 19 nt, Artificial Sequence
  Description of Artificial Sequence: Synthetic iRNA agent targeting human EGLN3 oligonucleotide
uugagaauuaauggugaca

SEQ ID NO: 2703 - RNA, 19 nt, Artificial Sequence
  Description of Artificial Sequence: Synthetic iRNA agent targeting human EGLN3 oligonucleotide
caccauuaauucucaacga

SEQ ID NO: 2704 - RNA, 19 nt, Artificial Sequence
  Description of Artificial Sequence: Synthetic iRNA agent targeting human EGLN3 oligonucleotide
ucguugagaauuaauggug

SEQ ID NO: 2705 - RNA, 19 nt, Artificial Sequence
  Description of Artificial Sequence: Synthetic iRNA agent targeting human EGLN3 oligonucleotide
ccauuaauucucaacgacu

SEQ ID NO: 2706 - RNA, 19 nt, Artificial Sequence
  Description of Artificial Sequence: Synthetic iRNA agent targeting human EGLN3 oligonucleotide
agucguugagaauuaaugg

SEQ ID NO: 2707 - RNA, 19 nt, Artificial Sequence
  Description of Artificial Sequence: Synthetic iRNA agent targeting human EGLN3 oligonucleotide
uuaauucucaacgacugcu

SEQ ID NO: 2708 - RNA, 19 nt, Artificial Sequence
  Description of Artificial Sequence: Synthetic iRNA agent targeting human EGLN3 oligonucleotide
agcagucguugagaauuaa

SEQ ID NO: 2709 - RNA, 19 nt, Artificial Sequence
  Description of Artificial Sequence: Synthetic iRNA agent targeting human EGLN3 oligonucleotide
aauucucaacgacugcucu

SEQ ID NO: 2710 - RNA, 19 nt, Artificial Sequence
  Description of Artificial Sequence: Synthetic iRNA agent targeting human EGLN3 oligonucleotide
agagcagucguugagaauu

SEQ ID NO: 2711 - RNA, 19 nt, Artificial Sequence
  Description of Artificial Sequence: Synthetic iRNA agent targeting human EGLN3 oligonucleotide
uucucaacgacugcucuau

SEQ ID NO: 2712 - RNA, 19 nt, Artificial Sequence
  Description of Artificial Sequence: Synthetic iRNA agent targeting human EGLN3 oligonucleotide
auagagcagucguugagaa

SEQ ID NO: 2713 - RNA, 19 nt, Artificial Sequence
  Description of Artificial Sequence: Synthetic iRNA agent targeting human EGLN3 oligonucleotide
ucucaacgacugcucuauu

SEQ ID NO: 2714 - RNA, 19 nt, Artificial Sequence
  Description of Artificial Sequence: Synthetic iRNA agent targeting human EGLN3 oligonucleotide
aauagagcagucguugaga

SEQ ID NO: 2715 - RNA, 19 nt, Artificial Sequence
  Description of Artificial Sequence: Synthetic iRNA agent targeting human EGLN3 oligonucleotide
cucaacgacugcucuauuu

SEQ ID NO: 2716 - RNA, 19 nt, Artificial Sequence
  Description of Artificial Sequence: Synthetic iRNA agent targeting human EGLN3 oligonucleotide
aaauagagcagucguugag

SEQ ID NO: 2717 - RNA, 19 nt, Artificial Sequence
  Description of Artificial Sequence: Synthetic iRNA agent targeting human EGLN3 oligonucleotide
aacgacugcucuauuuugu

SEQ ID NO: 2718 - RNA, 19 nt, Artificial Sequence
  Description of Artificial Sequence: Synthetic iRNA agent targeting human EGLN3 oligonucleotide
acaaaauagagcagucguu

SEQ ID NO: 2719 - RNA, 19 nt, Artificial Sequence
  Description of Artificial Sequence: Synthetic iRNA agent targeting human EGLN3 oligonucleotide
ucuauuuuguuguacggua

SEQ ID NO: 2720 - RNA, 19 nt, Artificial Sequence
  Description of Artificial Sequence: Synthetic iRNA agent targeting human EGLN3 oligonucleotide
uaccguacaacaaaauaga

SEQ ID NO: 2721 - RNA, 19 nt, Artificial Sequence
  Description of Artificial Sequence: Synthetic iRNA agent targeting human EGLN3 oligonucleotide
uauuuuguuguacgguaau

SEQ ID NO: 2722 - RNA, 19 nt, Artificial Sequence
  Description of Artificial Sequence: Synthetic iRNA agent targeting human EGLN3 oligonucleotide
auuaccguacaacaaaaua

SEQ ID NO: 2723 - RNA, 19 nt, Artificial Sequence
  Description of Artificial Sequence: Synthetic iRNA agent targeting human EGLN3 oligonucleotide
auuuuguuguacgguaaua

SEQ ID NO: 2724 - RNA, 19 nt, Artificial Sequence
  Description of Artificial Sequence: Synthetic iRNA agent targeting human EGLN3 oligonucleotide
uauuaccguacaacaaaau

SEQ ID NO: 2725 - RNA, 19 nt, Artificial Sequence
  Description of Artificial Sequence: Synthetic iRNA agent targeting human EGLN3 oligonucleotide
uuuguuguacgguaauagu

SEQ ID NO: 2726 - RNA, 19 nt, Artificial Sequence
  Description of Artificial Sequence: Synthetic iRNA agent targeting human EGLN3 oligonucleotide
acuauuaccguacaacaaa

SEQ ID NO: 2727 - RNA, 19 nt, Artificial Sequence
  Description of Artificial Sequence: Synthetic iRNA agent targeting human EGLN3 oligonucleotide
uuguuguacgguaauaguu

SEQ ID NO: 2728 - RNA, 19 nt, Artificial Sequence
  Description of Artificial Sequence: Synthetic iRNA agent targeting human EGLN3 oligonucleotide
aacuauuaccguacaacaa

SEQ ID NO: 2729 - RNA, 19 nt, Artificial Sequence
  Description of Artificial Sequence: Synthetic iRNA agent targeting human EGLN3 oligonucleotide
uguuguacgguaauaguua

SEQ ID NO: 2730 - RNA, 19 nt, Artificial Sequence
  Description of Artificial Sequence: Synthetic iRNA agent targeting human EGLN3 oligonucleotide
uaacuauuaccguacaaca

SEQ ID NO: 2731 - RNA, 19 nt, Artificial Sequence
  Description of Artificial Sequence: Synthetic iRNA agent targeting human EGLN3 oligonucleotide
guuguacgguaauaguuau

SEQ ID NO: 2732 - RNA, 19 nt, Artificial Sequence
  Description of Artificial Sequence: Synthetic iRNA agent targeting human EGLN3 oligonucleotide
auaacuauuaccguacaac

SEQ ID NO: 2733 - RNA, 19 nt, Artificial Sequence
  Description of Artificial Sequence: Synthetic iRNA agent targeting human EGLN3 oligonucleotide
acgguaauaguuaucaccu

SEQ ID NO: 2734 - RNA, 19 nt, Artificial Sequence
  Description of Artificial Sequence: Synthetic iRNA agent targeting human EGLN3 oligonucleotide
aggugauaacuauuaccgu

SEQ ID NO: 2735 - RNA, 19 nt, Artificial Sequence
  Description of Artificial Sequence: Synthetic iRNA agent targeting human EGLN3 oligonucleotide
aauaguuaucaccuucuaa

SEQ ID NO: 2736 - RNA, 19 nt, Artificial Sequence
  Description of Artificial Sequence: Synthetic iRNA agent targeting human EGLN3 oligonucleotide
uuagaaggugauaacuauu

SEQ ID NO: 2737 - RNA, 19 nt, Artificial Sequence
  Description of Artificial Sequence: Synthetic iRNA agent targeting human EGLN3 oligonucleotide
auaguuaucaccuucuaaa

SEQ ID NO: 2738 - RNA, 19 nt, Artificial Sequence
  Description of Artificial Sequence: Synthetic iRNA agent targeting human EGLN3 oligonucleotide
uuuagaaggugauaacuau

SEQ ID NO: 2739 - RNA, 19 nt, Artificial Sequence
  Description of Artificial Sequence: Synthetic iRNA agent targeting human EGLN3 oligonucleotide
cuaaauuacuauguaauuu

SEQ ID NO: 2740 - RNA, 19 nt, Artificial Sequence
  Description of Artificial Sequence: Synthetic iRNA agent targeting human EGLN3 oligonucleotide
aaauuacauaguaauuuag

SEQ ID NO: 2741 - RNA, 19 nt, Artificial Sequence
  Description of Artificial Sequence: Synthetic iRNA agent targeting human EGLN3 oligonucleotide
cacuuauuauguuuauugu

SEQ ID NO: 2742 - RNA, 19 nt, Artificial Sequence
  Description of Artificial Sequence: Synthetic iRNA agent targeting human EGLN3 oligonucleotide
acaauaaacauaauaagug

SEQ ID NO: 2743 - RNA, 19 nt, Artificial Sequence
  Description of Artificial Sequence: Synthetic iRNA agent targeting human EGLN3 oligonucleotide
uuauugucuuguauccuuu

SEQ ID NO: 2744 - RNA, 19 nt, Artificial Sequence
  Description of Artificial Sequence: Synthetic iRNA agent targeting human EGLN3 oligonucleotide
aaaggauacaagacaauaa

SEQ ID NO: 2745 - RNA, 19 nt, Artificial Sequence
  Description of Artificial Sequence: Synthetic iRNA agent targeting human EGLN3 oligonucleotide
uguauccuuucucuggagu

SEQ ID NO: 2746 - RNA, 19 nt, Artificial Sequence
  Description of Artificial Sequence: Synthetic iRNA agent targeting human EGLN3 oligonucleotide
acuccagagaaaggauaca

SEQ ID NO: 2747 - RNA, 19 nt, Artificial Sequence
  Description of Artificial Sequence: Synthetic iRNA agent targeting human EGLN3 oligonucleotide
uauccuuucucuggagugu

SEQ ID NO: 2748 - RNA, 19 nt, Artificial Sequence
  Description of Artificial Sequence: Synthetic iRNA agent targeting human EGLN3 oligonucleotide
acacuccagagaaaggaua

SEQ ID NO: 2749 - RNA, 19 nt, Artificial Sequence
  Description of Artificial Sequence: Synthetic iRNA agent targeting human EGLN3 oligonucleotide
uuucucuggaguguaagca

SEQ ID NO: 2750 - RNA, 19 nt, Artificial Sequence
  Description of Artificial Sequence: Synthetic iRNA agent targeting human EGLN3 oligonucleotide
ugcuuacacuccagagaaa

SEQ ID NO: 2751 - RNA, 19 nt, Artificial Sequence
  Description of Artificial Sequence: Synthetic iRNA agent targeting human EGLN3 oligonucleotide
cucuggaguguaagcacaa

SEQ ID NO: 2752 - RNA, 19 nt, Artificial Sequence
  Description of Artificial Sequence: Synthetic iRNA agent targeting human EGLN3 oligonucleotide
uugugcuuacacuccagag

SEQ ID NO: 2753 - RNA, 19 nt, Artificial Sequence
  Description of Artificial Sequence: Synthetic iRNA agent targeting human EGLN3 oligonucleotide
ucuggaguguaagcacaau

SEQ ID NO: 2754 - RNA, 19 nt, Artificial Sequence
  Description of Artificial Sequence: Synthetic iRNA agent targeting human EGLN3 oligonucleotide
auugugcuuacacuccaga

SEQ ID NO: 2755 - RNA, 19 nt, Artificial Sequence
  Description of Artificial Sequence: Synthetic iRNA agent targeting human EGLN3 oligonucleotide
aguguaagcacaaugaaga

SEQ ID NO: 2756 - RNA, 19 nt, Artificial Sequence
  Description of Artificial Sequence: Synthetic iRNA agent targeting human EGLN3 oligonucleotide
ucuucauugugcuuacacu

SEQ ID NO: 2757 - RNA, 19 nt, Artificial Sequence
  Description of Artificial Sequence: Synthetic iRNA agent targeting human EGLN3 oligonucleotide
agcacaaugaagacaggaa

SEQ ID NO: 2758 - RNA, 19 nt, Artificial Sequence
  Description of Artificial Sequence: Synthetic iRNA agent targeting human EGLN3 oligonucleotide
uuccugucuucauugugcu

SEQ ID NO: 2759 - RNA, 19 nt, Artificial Sequence
  Description of Artificial Sequence: Synthetic iRNA agent targeting human EGLN3 oligonucleotide
cacaaugaagacaggaauu

SEQ ID NO: 2760 - RNA, 19 nt, Artificial Sequence
  Description of Artificial Sequence: Synthetic iRNA agent targeting human EGLN3 oligonucleotide
aauuccugucuucauugug

SEQ ID NO: 2761 - RNA, 19 nt, Artificial Sequence
  Description of Artificial Sequence: Synthetic iRNA agent targeting human EGLN3 oligonucleotide
acaaugaagacaggaauuu

SEQ ID NO: 2762 - RNA, 19 nt, Artificial Sequence
  Description of Artificial Sequence: Synthetic iRNA agent targeting human EGLN3 oligonucleotide
aaauuccugucuucauugu

SEQ ID NO: 2763 - RNA, 19 nt, Artificial Sequence
  Description of Artificial Sequence: Synthetic iRNA agent targeting human EGLN3 oligonucleotide
gaagacaggaauuuuguau

SEQ ID NO: 2764 - RNA, 19 nt, Artificial Sequence
  Description of Artificial Sequence: Synthetic iRNA agent targeting human EGLN3 oligonucleotide
auacaaaauuccugucuuc

SEQ ID NO: 2765 - RNA, 19 nt, Artificial Sequence
  Description of Artificial Sequence: Synthetic iRNA agent targeting human EGLN3 oligonucleotide
auuuuuaaccaaugcaaca

SEQ ID NO: 2766 - RNA, 19 nt, Artificial Sequence
  Description of Artificial Sequence: Synthetic iRNA agent targeting human EGLN3 oligonucleotide
uguugcauugguuaaaaau

SEQ ID NO: 2767 - RNA, 19 nt, Artificial Sequence
  Description of Artificial Sequence: Synthetic iRNA agent targeting human EGLN3 oligonucleotide
aaccaaugcaacauacucu

SEQ ID NO: 2768 - RNA, 19 nt, Artificial Sequence
  Description of Artificial Sequence: Synthetic iRNA agent targeting human EGLN3 oligonucleotide
agaguauguugcauugguu

SEQ ID NO: 2769 - RNA, 19 nt, Artificial Sequence
  Description of Artificial Sequence: Synthetic iRNA agent targeting human EGLN3 oligonucleotide
augcaacauacucucagca

SEQ ID NO: 2770 - RNA, 19 nt, Artificial Sequence
  Description of Artificial Sequence: Synthetic iRNA agent targeting human EGLN3 oligonucleotide
ugcugagaguauguugcau

SEQ ID NO: 2771 - RNA, 19 nt, Artificial Sequence
  Description of Artificial Sequence: Synthetic iRNA agent targeting human EGLN3 oligonucleotide
caacauacucucagcaccu

SEQ ID NO: 2772 - RNA, 19 nt, Artificial Sequence
  Description of Artificial Sequence: Synthetic iRNA agent targeting human EGLN3 oligonucleotide
aggugcugagaguauguug

SEQ ID NO: 2773 - RNA, 19 nt, Artificial Sequence
  Description of Artificial Sequence: Synthetic iRNA agent targeting human EGLN3 oligonucleotide
aacauacucucagcaccua

SEQ ID NO: 2774 - RNA, 19 nt, Artificial Sequence
  Description of Artificial Sequence: Synthetic iRNA agent targeting human EGLN3 oligonucleotide
uaggugcugagaguauguu

SEQ ID NO: 2775 - RNA, 19 nt, Artificial Sequence
  Description of Artificial Sequence: Synthetic iRNA agent targeting human EGLN3 oligonucleotide
acauacucucagcaccuaa

SEQ ID NO: 2776 - RNA, 19 nt, Artificial Sequence
  Description of Artificial Sequence: Synthetic iRNA agent targeting human EGLN3 oligonucleotide
uuaggugcugagaguaugu

SEQ ID NO: 2777 - RNA, 19 nt, Artificial Sequence
  Description of Artificial Sequence: Synthetic iRNA agent targeting human EGLN3 oligonucleotide
cauacucucagcaccuaaa

SEQ ID NO: 2778 - RNA, 19 nt, Artificial Sequence
  Description of Artificial Sequence: Synthetic iRNA agent targeting human EGLN3 oligonucleotide
uuuaggugcugagaguaug

SEQ ID NO: 2779 - RNA, 19 nt, Artificial Sequence
  Description of Artificial Sequence: Synthetic iRNA agent targeting human EGLN3 oligonucleotide
aaaauagugccgggaacau

SEQ ID NO: 2780 - RNA, 19 nt, Artificial Sequence
  Description of Artificial Sequence: Synthetic iRNA agent targeting human EGLN3 oligonucleotide
auguucccggcacuauuuu

SEQ ID NO: 2781 - RNA, 19 nt, Artificial Sequence
  Description of Artificial Sequence: Synthetic iRNA agent targeting human EGLN3 oligonucleotide
auagugccgggaacauagu

SEQ ID NO: 2782 - RNA, 19 nt, Artificial Sequence
  Description of Artificial Sequence: Synthetic iRNA agent targeting human EGLN3 oligonucleotide
acuauguucccggcacuau

SEQ ID NO: 2783 - RNA, 19 nt, Artificial Sequence
  Description of Artificial Sequence: Synthetic iRNA agent targeting human EGLN3 oligonucleotide
cgggaacauaguaagggcu

SEQ ID NO: 2784 - RNA, 19 nt, Artificial Sequence
  Description of Artificial Sequence: Synthetic iRNA agent targeting human EGLN3 oligonucleotide
agcccuuacuauguucccg

SEQ ID NO: 2785 - RNA, 19 nt, Artificial Sequence
  Description of Artificial Sequence: Synthetic iRNA agent targeting human EGLN3 oligonucleotide
aacauaguaagggcucagu

SEQ ID NO: 2786 - RNA, 19 nt, Artificial Sequence
  Description of Artificial Sequence: Synthetic iRNA agent targeting human EGLN3 oligonucleotide
acugagcccuuacuauguu

SEQ ID NO: 2787 - RNA, 19 nt, Artificial Sequence
  Description of Artificial Sequence: Synthetic iRNA agent targeting human EGLN3 oligonucleotide
uaagggcucaguaaauacu

SEQ ID NO: 2788 - RNA, 19 nt, Artificial Sequence
  Description of Artificial Sequence: Synthetic iRNA agent targeting human EGLN3 oligonucleotide
aguauuuacugagcccuua

SEQ ID NO: 2789 - RNA, 19 nt, Artificial Sequence
  Description of Artificial Sequence: Synthetic iRNA agent targeting human EGLN3 oligonucleotide
aagggcucaguaaauacuu

SEQ ID NO: 2790 - RNA, 19 nt, Artificial Sequence
  Description of Artificial Sequence: Synthetic iRNA agent targeting human EGLN3 oligonucleotide
aaguauuuacugagcccuu

SEQ ID NO: 2791 - RNA, 19 nt, Artificial Sequence
  Description of Artificial Sequence: Synthetic iRNA agent targeting human EGLN3 oligonucleotide
uacuuguugaauaaacuca

SEQ ID NO: 2792 - RNA, 19 nt, Artificial Sequence
  Description of Artificial Sequence: Synthetic iRNA agent targeting human EGLN3 oligonucleotide
ugaguuuauucaacaagua

SEQ ID NO: 2793 - RNA, 19 nt, Artificial Sequence
  Description of Artificial Sequence: Synthetic iRNA agent targeting human EGLN3 oligonucleotide
cuuguugaauaaacucagu

SEQ ID NO: 2794 - RNA, 19 nt, Artificial Sequence
  Description of Artificial Sequence: Synthetic iRNA agent targeting human EGLN3 oligonucleotide
acugaguuuauucaacaag

SEQ ID NO: 2795 - RNA, 19 nt, Artificial Sequence
  Description of Artificial Sequence: Synthetic iRNA agent targeting human EGLN3 oligonucleotide
ucagucuccuacauuagca

SEQ ID NO: 2796 - RNA, 19 nt, Artificial Sequence
  Description of Artificial Sequence: Synthetic iRNA agent targeting human EGLN3 oligonucleotide
ugcuaauguaggagacuga

SEQ ID NO: 2797 - RNA, 19 nt, Artificial Sequence
  Description of Artificial Sequence: Synthetic iRNA agent targeting human EGLN3 oligonucleotide
agucuccuacauuagcauu

SEQ ID NO: 2798 - RNA, 19 nt, Artificial Sequence
  Description of Artificial Sequence: Synthetic iRNA agent targeting human EGLN3 oligonucleotide
aaugcuaauguaggagacu

SEQ ID NO: 2799 - RNA, 19 nt, Artificial Sequence
  Description of Artificial Sequence: Synthetic iRNA agent targeting human EGLN3 oligonucleotide
ucuccuacauuagcauucu

SEQ ID NO: 2800 - RNA, 19 nt, Artificial Sequence
  Description of Artificial Sequence: Synthetic iRNA agent targeting human EGLN3 oligonucleotide
agaaugcuaauguaggaga

SEQ ID NO: 2801 - RNA, 19 nt, Artificial Sequence
  Description of Artificial Sequence: Synthetic iRNA agent targeting human EGLN3 oligonucleotide
cuccuacauuagcauucua

SEQ ID NO: 2802 - RNA, 19 nt, Artificial Sequence
  Description of Artificial Sequence: Synthetic iRNA agent targeting human EGLN3 oligonucleotide
uagaaugcuaauguaggag

SEQ ID NO: 2803 - RNA, 19 nt, Artificial Sequence
  Description of Artificial Sequence: Synthetic iRNA agent targeting human EGLN3 oligonucleotide
uccuacauuagcauucuaa

SEQ ID NO: 2804 - RNA, 19 nt, Artificial Sequence
  Description of Artificial Sequence: Synthetic iRNA agent targeting human EGLN3 oligonucleotide
uuagaaugcuaauguagga

SEQ ID NO: 2805 - DNA, 9637 bp, Homo sapiens
ctggggagctgccgatctcggggtgtgagggtaacgggcaggctgtggcccacccctccttctcaggctcactggacccctgaccggtttcatcaccattatccaaggctttgaaaagaccccctggccttcctgccacatgtgccctagctatagggcttcgttcccctccacaaatggtgcagacagcatgagccaccctggcagggggctgggggtccgtggggtaggagttgggggtagctgagcgttctttcctgtccccacggtgcctggtgctggggcttggcagccagggttgggacagcctggctttagcaggtcctgagtcaggggtctcaggctccgcagcacacagtccccaggcaggtgtcaggatgggatgtggccagagaaaggcatgtgctctgtctggggatagctgccacccagctgacacagttggcatgagattgtggagttttatggagtaaaatcacaaatctgggttttttaagtaaaaccttctatgagttgccatctctggccttcaacataggatttgggtctttcctgggtgagctggtgctttgtgggccaggccctgggagctgcaagtaccagttgggatctgccattgccctgtggaaggattttaagcaggggtgaaacatggtcagacttggatttagagatgaggaaaaaaaacaaaatcacggtgccagagtctctggggagactggagaatgcagtgcaggggccgcaggagccaaaaaggggcactggtcctgcgaagagtggctctgtccatccctgccttccagtatgtgcccactgtgaccagagctccatttctcaaaagaagccagtgatgccaattaccatgagaaatttccttatttttaactgtcgattaaaatttgtacaagtatggtggggcaggcctgcaaaatgatctccaagtgcctggcctttgatgcccgtcctaaaagcatgtgtggcactggagggcccacgtttctttgttcctcttgagaagctggggtgggggccggctgggctcagggtgcggcccctcacttcccagggctgtggtctcggtggggcctgcactgttcctgggtgtccttgggctgagcctctgccctgtgaggacggccgctcaggcatgatccgtcagcgaagccgtggctgtgactctgttttccgcagtggagcggaggcggagggacaagatcaacaactggatcgtccagctttcgaaaatcattccagactgtaacgcagacaacagcaagacgggagcggtgagcaccccggaccctcagtgtctgcggtggtcccggcccccgacccttgcatgcagaaagtccaacagccatggggctcgggagtcatccctggggtggaggccggtgggcggtgcctgccctaaggctcctggtcccctcgccccccagagtaaaggagggatcctgtccaaggcctgcgattacatccgggagttgcgccagaccaaccagcgcatgcaggagaccttcaaagaggccgagcggctgcagatggacaacgagctcctgaggcagcaggtgggtgcggggcctggagcgggtcagggcccaggagccccagatgcaaggcgctggccctcagctcccttgacctccgtcgtgtccgccagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgccttgtctgcttgtgtgtttgtccatctcaggagtggggagggggcctggggtctgcagagctccacgaggcatggttctgctgttgtgcacatggctgtgcatggtccctgccagctgcaccacccattacccagtggttggttggatggatggaggaattaaggaatgaatgtcccctttgaggccctagacgtgcatgagggtgtggggagctggggtcaaggacatgtcccatgttggaggagaggcaggggtctccgtgtcaacagttcctgaaaacacaaccagcccctggccctgccctgctgggccaaagccctcccctctgcaccagccaatagtggggcctggccttgagcccctcacccccagggagggcagatggccagggcgccaagcttggcccgtcagcctgtcgccttgcaccaaggctctggcgcctgtgctgtgacccctgcccctgctgatgatgaaacctgtcctcagctgagatgcagcgatgcctggtagggctgggggctgctcctgtgtctccccaggtgagcacacccctattcactgggccctgcttcagcctgcagcacccttcaactcccaggagctgggcttgccactctgctcaccttgtggagctccatctgcctttcctccccaattcccccactccctgcactcgtctcttcccacaagagccctgtctccttttcctagctattcccatctgaggccatctttattcatttagtttttagagacagggtttcactctcacccaggctggggtgcagtggcacacaatcacggctcactgcagccttgaccaactacaggtgcgtagcaccacagccaagtttttgtatagatggggtctcgctttgttacccaggctgtgacaagaggagcctcccacgtggtgtggatgaggaggcagatggcagggcctgtgcatttctgtgcttgagtgggccttgaaagtggttcagcaaccaggaagaagtgttcattcctcgacaacaacatccccgggctctggtgacttggctgacactggatggccctggaatgaaaaaggcaaagaggcaaaatgtgcaagggcccatctggaaccaaggtttgttgatcccctgggccgtgtgcaccctgagctgggcctggtagtggaaaggaatgaaggcactgcagtcaggcagcctgggttcatcccccagctagtggtgtcctaaggaaccggctccccaaaaacatccctggcttgtagtgcttgccaatttctgggtgtcaagactcccactgctgctgatttcaggataccagcatgatgccactgaatgcagagtttcgagatgtgcatggtctgctatgttgagccaggtctagcataccgctgtgccctgctgtgttttaggggagatggggaaacctggtgggtaagagcaaaagccctggagtcaggctgtccaggctagaatctcagctctgcctctggctgagcaagcttgggccatgccctgatctctgccttcagtgccttttctgtaaagtgaaggaaatgagtgtccgacggggaggaggttcctaaaagggagcagggtctggggagcccaggcctctggggttgggtgactgagaaggcagcccctgaatacagagcagagctgaaggtggggcagtaagtgctgctgggagaacaggcagcacaggctgagttggtgcagaagtgagtcaacatatgtgccatcgtataaaatgtactcatcggactgtagatgttagctattactattactgctattttatgttttatagacagggtctcactctgtcacccaggctggagtgcagtcacacaatcatagctcactgcaacctcagcctcctgggcttaagcgatctgcctcagcctcccaagtagctgggactacagatgtgtgccaccacgcctggctaaatttgtttaaaattttttttgtagagatggggtctccctatgttgcccaggctagtcttgaacttctgggctcaagcgaccctcctgccttggcctcccaaattgctgggattacaggcataagccactgtgctgggccatattactgctgtcatttatggccaaaagtttgctcaaacattttccagttaccagagccacatctcaagggtctgacactgggaaaacaccacgtgcggatcgggcacacgctgatgcttgccctgctcagggctatctagtgttccctgccagaacctatgcacgtgtggtgagagcttaaagcaatggatgcttcccccaacatgccagacactcctgaggagcctggcggctgctggccatgccccgtgtgcatgtaggcgatggggaagtgagtggaggagagcggaaccttgattctgctcatcaaactgcttaaccgctgaagcaaaagggggaacttttttcccgatcagcagaatgacatcgtgatggggaaagggctccccagatggctggtgagcagtgtgtgtctgtgaccccgtctgccccaccccctgaacacacctctgccggctgagggtgacacaaccctgttccctgtcgctctgttcccgcttatctctcccgccttttcggcgccaccaccttcttggaaatgagacagagcaaaggggagggggctcagaccaccgcctcccctggcaggccccataaaagcgactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacaggtgagagcccagtggcctgggtccttagcagggcagcagggatgggagagccaggcctcagcctagggcactggagacacccgagcactgagcagagctcaggacgtctcaggagtactggcagctgaacaggaaccaggacaggcacggtggctcatgcctgtaatcccagcactttgggaggttgaggcaggcagcccacttgaggtcagtttgagaccagcctggccaacatggtaaaaccccgtctctactaaaaatacaaaagttagccaggcttggtggcaggtgcctgtaatcccagctactcgggagactgaggcaggagaattgcttgaacccgcaaggtggaggttgcacagtgagctgagattgcaccactgcactccagcctggcaacagagcaagactccatctccaaaaaagaacagaaatcaatgaagcaccgagtgacagggactggaaggtcctaattccatgggtatttacggaacccctacgccgtgtggagtcttattctagacagtggggacgaggccatgaacaaggtagatgagagaggagatttctccatcctggtcagggaatttgttaaagactgatgaaaacatgaataaataattgtgtctagtacattctattcgtgaatctcataacagacagtggtagagtgaccgtgacccattcgccacacagtagagtcacttttttggtttgttttttagagacagggtcttcctctgttgctgaggctggagtgcagtggtgcagtcatagttcactgcagcctcaacctcctgtgctcaagcaatcctcccacctcagcgtcccaagtagctgggacagcaggcacatgccacgggttgggggaccacaggcatggtcaaggggctggcagtcaagcaagtgtttcatgagaaagtgacagttgaccttcgtcttggagggtgagagatggaggcagcaaagacctaaggagaggacaagccagcatagcccagggtcaggctgaacaagaggagatggtgggacttggggataaggctgaggggtgggcagtccctaagtcttgtgggcaaccatgcagacactgatttttccttggaataaagaggaagcccccataagcttttttttttttttctgagatagggtctcgctctgtcgttcaggctggtgtgcagtggcatcatctgggctcactgcaacctccgcctcccgggttcaagcaattctcctgcctcagcttcccgagcagctgggattacaggcggctgccaccacgcccggctaatttttgtttttttagtagagacagggtttcaccatgttggccagactggtcttgaactcctgacctcaggtgattctcccacctcggcttcccaaagtgctgggattacaggcgtgagccactgcgcccagcctcctgtaggtttttaaaatggagaaaaccacaatctcactggccatgttttaaaaaacttaatctgccagtcaggcaccatggctcacacctgtaatcccagagttttgggaggccaaggtaggaagatcagttgagcccaggagttcaagaccagcttgggcaacacaaccagaccccacctctacaaaaaattaaaaaattagccgggtgtggtggcgtgcacctgctgtcccagctactcgggaagctgaggcgggagcatcgcttgagcacaggaggtcaaggctgcagggagctatgactgtgccactgcactctggcctgggcaacagaggaagactctgtctaaaaaacaaacaaaaaaagtgactctgctgtgtggcaaatggattgaggggcaagaatgcagggaggtgtgttaggaggctggcactggcatccaggcaggggaaggtgatatcccaaagaagagtagcagctgtggaaagaggaggaggcggatctgggaggtttttttttttaggaaaagccgcccatgggaaggtgagcagaagcaagaaagcaaggcccctcctaagagtccatttgagctctgggtttaaaccacttggagaggagcaggttgccgggagccagtctcagaggtccactgggccccctgccatcctctgcacccccttctgctttcacagacgggacaacttgcagagctgcaaccccaggacagagctggagccagggccagctggatggtgagcgcaacagtgatgcctttcctagccccctgctccctccccatgctaaggccggttccctgctcacattcccttccttcccacagcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttccaaaccagagtgtctgttgtcctttctctctgccgagtgtctgtgctaagagcttgtcctgaccctgccttgcaagcaccagtgcttggtgggtcatgtggggctggtgtgtcctggaggttgccaggaaagttggtgaagaaaatttgtttctgttctcccccttcatgttgcaataataggggatgaaagttaatgtttcctctccttgagatcttcctaaaacagctgtagaaatcagtgcctgtaaggcaagcttgtccaacctggaggccacatgcagccctggatggctttgaatgcacccaacacaaatttgtagtttcttaaggcattatgagatttttccgcaatttttttttttctcatcagctgtcattagtgttagtgtgttttatgtgtggcccaagacaattcttccagtgtggcccagggaagccaaaacattggacactgctataaaggttctcaaagtaagatccagggactccttttgtagggctcctgaaggtggaaactactaagactttttttttcctttttttttccttttttttctttcttttttttttttttttgaggcagagtctctctgtgtcacccaggctggagggcagtggcatgatcttggctcactgcaacctccacctcccaggttcaagcgattcccctgcctcagcctcctgaatagctgggactacaggcacgtgccaccacacctggctaatttttgtatttttagtagaggtggggttttgccatgttgtccaggctggtctcgaactcctgacctcaagtgatccacccgtctcagtctcccaaagtgctgagattacaggtgtgagccaccacgcccggcctacaaagatgtttatttgcctttttcaccctggttctctcatgagtatacaatggagtttccaggaggctctgcgacacctgttggcatcatcaccagatggctaatggattgtgtgctggtgtatctcacgcttttaaatgtcccagtttctagcccggtgcagttgcaccagccctgctactcgggaggctgaggcaggaggataatttaagactgggagttccagaagaagacctggtgtcaaaaaaaaaaaaaatggggcaacgaaaatgagagcaatacagctttcaagaatgggaggggccaggggtggtgattcatgcctacagcactttgggtggctgaggcaggcagatcacttgaggtcaggagttcaagaccagcctggccaacatggtgaaacaccgtctctacaaaaattagccaggcatggtggcatgtgcctgtaatcccagctagtcaggaggctgagtcaggagaatcacttgaaccctggaggtggaggttacagtgagccaagacaacactgctgcactccagcctgggcgacggagtgagaccctgtctccagaaaaaaaaaaaaagaagaatgggcaggaactcagttccttgtggaggtgaactatattcctatatgtttcacgtgcaaagtgtgtccttcctgagagaatacaacttaagatgctcctgtgtaacaatcccccatacctcgctcatctgctatacctggatggcctctgaaggccatgggcctcacaccttttggtcttaggacccctttacattctgagaaattattgaggactccaaaaagctcttgataaagtgggctatatctctagttgcctgatgtattagaaactgaaactgggaaaatatttttactgtttatttatttatttttgagacagggtctcactctgtcgcccaggctggagtgcagtggcgcgatctcagctcactgcaaactccacctcccagtttcaagcggttctcctgccttggcctcctgagtagctggaactacaggcgcccgccaccatgcctggctaattttcatatttttagtagagacagggtttcaccgtgttggccaagctggtcttaaacgcctaacctcaagtgatccacccgcctcagcc

SEQ ID NO: 2806 - DNA, 598 bp, Homo sapiens
aacacacctctgccggctgagggtgacacaaccctgttccctgtcgctctgttcccgcttatctctcccgccttttcggcgccaccaccttcttggaaatgagacagagcaaaggggagggggctcagaccaccgcctcccctggcaggccccataaaagcgactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacagacgggacaacttgcagagctgcaaccccaggacagagctggagccagggccagctggatgcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttccaaaaaaaaaaaaa

SEQ ID NO: 2807 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
cacgacaccgggaaguucatt

SEQ ID NO: 2808 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
ugaacuucccggugucgugtt

SEQ ID NO: 2809 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gacugggaugccaagguaatt

SEQ ID NO: 2810 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uuaccuuggcaucccaguctt

SEQ ID NO: 2811 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
ccaagguaaguggagguautt

SEQ ID NO: 2812 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
auaccuccacuuaccuuggtt

SEQ ID NO: 2813 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
guggagguauacuucgaautt

SEQ ID NO: 2814 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
auucgaaguauaccuccactt

SEQ ID NO: 2815 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
guggagguauacuucgaautt

SEQ ID NO: 2816 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
auucgaaguauaccuccactt

SEQ ID NO: 2817 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gagguauacuucgaauuuutt

SEQ ID NO: 2818 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
aaaauucgaaguauaccuctt

SEQ ID NO: 2819 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
ccaaauuugauagacugcutt

SEQ ID NO: 2820 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
agcagucuaucaaauuuggtt

SEQ ID NO: 2821 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gcuacaagguacgcaauaatt

SEQ ID NO: 2822 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uuauugcguaccuuguagctt

SEQ ID NO: 2823 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gagagcacgagcuaaaguatt

SEQ ID NO: 2824 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uacuuuagcucgugcucuctt

SEQ ID NO: 2825 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gagcuaaaguaaaauaucutt

SEQ ID NO: 2826 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
agauauuuuacuuuagcuctt

SEQ ID NO: 2827 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gugugaggguugaacucaatt

SEQ ID NO: 2828 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uugaguucaacccucacactt

SEQ ID NO: 2829 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gugaggguugaacucaauatt

SEQ ID NO: 2830 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uauugaguucaacccucactt

SEQ ID NO: 2831 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gguugaacucaauaaaccutt

SEQ ID NO: 2832 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
agguuuauugaguucaacctt

SEQ ID NO: 2833 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gacgucuucuagagccuuutt

SEQ ID NO: 2834 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
aaaggcucuagaagacguctt

SEQ ID NO: 2835 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
ccagaucuguuaucuagcutt

SEQ ID NO: 2836 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
agcuagauaacagaucuggtt

SEQ ID NO: 2837 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
guuaucuagcugaguucautt

SEQ ID NO: 2838 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
augaacucagcuagauaactt

SEQ ID NO: 2839 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gguacaauuuaucuaaacutt

SEQ ID NO: 2840 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
aguuuagauaaauuguacctt

SEQ ID NO: 2841 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
ccucuuaauaaugauuguutt

SEQ ID NO: 2842 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
aacaaucauuauuaagaggtt

SEQ ID NO: 2843 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gccagugacugaugauuaatt

SEQ ID NO: 2844 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uuaaucaucagucacuggctt

SEQ ID NO: 2845 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
ccagugacugaugauuaautt

SEQ ID NO: 2846 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
auuaaucaucagucacuggtt

SEQ ID NO: 2847 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gagcacuuuaauuacaacutt

SEQ ID NO: 2848 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
aguuguaauuaaagugcuctt

SEQ ID NO: 2849 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
ccauuuacuaccaauaacutt

SEQ ID NO: 2850 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
aguuauugguaguaaauggtt

SEQ ID NO: 2851 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
ggcugggguuuaaguuaaatt

SEQ ID NO: 2852 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uuuaacuuaaaccccagcctt

SEQ ID NO: 2853 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gcugggguuuaaguuaaautt

SEQ ID NO: 2854 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
auuuaacuuaaaccccagctt

SEQ ID NO: 2855 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
cuucaaguuccuaagauaatt

SEQ ID NO: 2856 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uuaucuuaggaacuugaagtt

SEQ ID NO: 2857 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gggcuuucuuaagcuuucatt

SEQ ID NO: 2858 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
ugaaagcuuaagaaagccctt

SEQ ID NO: 2859 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
cuuagacuucacuuuccuatt

SEQ ID NO: 2860 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uaggaaagugaagucuaagtt

SEQ ID NO: 2861 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
cuucacuuuccuaggcuuutt

SEQ ID NO: 2862 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
aaagccuaggaaagugaagtt

SEQ ID NO: 2863 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
cuaucucuguccuugaucutt

SEQ ID NO: 2864 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
agaucaaggacagagauagtt

SEQ ID NO: 2865 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gccaaaaugugaguauacatt

SEQ ID NO: 2866 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uguauacucacauuuuggctt

SEQ ID NO: 2867 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
caaaaugugaguauacagatt

SEQ ID NO: 2868 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
ucuguauacucacauuuugtt

SEQ ID NO: 2869 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
cuuaggagaauuugcaggatt

SEQ ID NO: 2870 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uccugcaaauucuccuaagtt

SEQ ID NO: 2871 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gcguuaggccacaacucaatt

SEQ ID NO: 2872 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uugaguuguggccuaacgctt

SEQ ID NO: 2873 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
cguuaggccacaacucaaatt

SEQ ID NO: 2874 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uuugaguuguggccuaacgtt

SEQ ID NO: 2875 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
cuaucuguggguugugcuutt

SEQ ID NO: 2876 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
aagcacaacccacagauagtt

SEQ ID NO: 2877 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
cagacaggucuuaaauugutt

SEQ ID NO: 2878 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
acaauuuaagaccugucugtt

SEQ ID NO: 2879 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
ggaaaaguuuauauacucutt

SEQ ID NO: 2880 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
agaguauauaaacuuuucctt

SEQ ID NO: 2881 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
cuguuuguggccuauaugutt

SEQ ID NO: 2882 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
acauauaggccacaaacagtt

SEQ ID NO: 2883 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
guuuguggccuauaugugutt

SEQ ID NO: 2884 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
acacauauaggccacaaactt

SEQ ID NO: 2885 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
guguuuaauccugguuaaatt

SEQ ID NO: 2886 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uuuaaccaggauuaaacactt

SEQ ID NO: 2887 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
guuuaauccugguuaaagatt

SEQ ID NO: 2888 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
ucuuuaaccaggauuaaactt

SEQ ID NO: 2889 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
cuguuuuuauucaacacautt

SEQ ID NO: 2890 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
auguguugaauaaaaacagtt

SEQ ID NO: 2891 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
cauauacagauagacuauatt

SEQ ID NO: 2892 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uauagucuaucuguauaugtt

SEQ ID NO: 2893 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
caaguugcuuguaaagcuatt

SEQ ID NO: 2894 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uagcuuuacaagcaacuugtt

SEQ ID NO: 2895 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gcuuguaaagcuaaucuaatt

SEQ ID NO: 2896 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uuagauuagcuuuacaagctt

SEQ ID NO: 2897 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gcuuguaaagcuaaucuaatt

SEQ ID NO: 2898 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uuagauuagcuuuacaagctt

SEQ ID NO: 2899 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
gcuuguaaagcuaaucuaatt

SEQ ID NO: 2900 - DNA, 21 bp, Artificial Sequence
  Description of Artificial Sequence: Synthetic iRNA agent targeting human EGLN1 oligonucleotide
  Description of Combined DNA/RNA Molecule: Synthetic iRNA agent targeting human EGLN1 oligonucleotide
uuagauuagcuuuacaagctt

SEQ ID NO: 2901 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cuucccaagcccuuagggatt

SEQ ID NO: 2902 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ucccuaagggcuugggaagtt

SEQ ID NO: 2903 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cuuggggaccagcaagcaatt

SEQ ID NO: 2904 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
uugcuugcugguccccaagtt

SEQ ID NO: 2905 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
caugcccgggggaugaagatt

SEQ ID NO: 2906 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ucuucaucccccgggcaugtt

SEQ ID NO: 2907 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cccgggggaugaagacacutt

SEQ ID NO: 2908 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
agugucuucaucccccgggtt

SEQ ID NO: 2909 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gggggaugaagacacugcutt

SEQ ID NO: 2910 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
agcagugucuucauccccctt

SEQ ID NO: 2911 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gcagccccuaagucaggcutt

SEQ ID NO: 2912 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
agccugacuuaggggcugctt

SEQ ID NO: 2913 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
caguuaccagggucuucgutt

SEQ ID NO: 2914 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
acgaagacccugguaacugtt

SEQ ID NO: 2915 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gaggcccccaaacggaaautt

SEQ ID NO: 2916 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
auuuccguuugggggccuctt

SEQ ID NO: 2917 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gggccaggcaagagaaccatt

SEQ ID NO: 2918 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ugguucucuugccuggccctt

SEQ ID NO: 2919 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gccuggcccuggacuauautt

SEQ ID NO: 2920 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
auauaguccagggccaggctt

SEQ ID NO: 2921 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gcaugcgguacuacggcautt

SEQ ID NO: 2922 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
augccguaguaccgcaugctt

SEQ ID NO: 2923 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gguacuacggcaucugcgutt

SEQ ID NO: 2924 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
acgcagaugccguaguacctt

SEQ ID NO: 2925 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cauccguggggaccagauutt

SEQ ID NO: 2926 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
aaucugguccccacggaugtt

SEQ ID NO: 2927 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cggguacguaaggcacguutt

SEQ ID NO: 2928 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
aacgugccuuacguacccgtt

SEQ ID NO: 2929 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gguacguaaggcacguugatt

SEQ ID NO: 2930 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ucaacgugccuuacguacctt

SEQ ID NO: 2931 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cgcugcaucaccuguaucutt

SEQ ID NO: 2932 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
agauacaggugaugcagcgtt

SEQ ID NO: 2933 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gcaucaccuguaucuauuatt

SEQ ID NO: 2934 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
uaauagauacaggugaugctt

SEQ ID NO: 2935 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gcaucaccuguaucuauuatt

SEQ ID NO: 2936 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
uaauagauacaggugaugctt

SEQ ID NO: 2937 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ccuguaucuauuaccugaatt

SEQ ID NO: 2938 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
uucagguaauagauacaggtt

SEQ ID NO: 2939 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
guaucuauuaccugaaucatt

SEQ ID NO: 2940 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ugauucagguaauagauactt

SEQ ID NO: 2941 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gaaucagaacugggacguutt

SEQ ID NO: 2942 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
aacgucccaguucugauuctt

SEQ ID NO: 2943 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cugggacguuaaggugcautt

SEQ ID NO: 2944 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
augcaccuuaacgucccagtt

SEQ ID NO: 2945 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cucuuugaccgguugcucatt

SEQ ID NO: 2946 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ugagcaaccggucaaagagtt

SEQ ID NO: 2947 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cuuugaccgguugcucauutt

SEQ ID NO: 2948 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
aaugagcaaccggucaaagtt

SEQ ID NO: 2949 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gaccgguugcucauuuucutt

SEQ ID NO: 2950 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
agaaaaugagcaaccgguctt

SEQ ID NO: 2951 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gugaagccagccuaugccatt

SEQ ID NO: 2952 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
uggcauaggcuggcuucactt

SEQ ID NO: 2953 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ccagguacgccaucacugutt

SEQ ID NO: 2954 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
acagugauggcguaccuggtt

SEQ ID NO: 2955 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ccaucacugucugguauuutt

SEQ ID NO: 2956 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
aaauaccagacagugauggtt

SEQ ID NO: 2957 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gcagcagccaaagacaagutt

SEQ ID NO: 2958 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
acuugucuuuggcugcugctt

SEQ ID NO: 2959 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cagccaaagacaaguaucatt

SEQ ID NO: 2960 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ugauacuugucuuuggcugtt

SEQ ID NO: 2961 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cagccaaagacaaguaucatt

SEQ ID NO: 2962 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ugauacuugucuuuggcugtt

SEQ ID NO: 2963 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
caaagacaaguaucagcuatt

SEQ ID NO: 2964 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
uagcugauacuugucuuugtt

SEQ ID NO: 2965 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gacaaguaucagcuagcautt

SEQ ID NO: 2966 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
augcuagcugauacuuguctt

SEQ ID NO: 2967 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
guaucagcuagcaucaggatt

SEQ ID NO: 2968 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
uccugaugcuagcugauactt

SEQ ID NO: 2969 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cagcuagcaucaggacagatt

SEQ ID NO: 2970 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ucuguccugaugcuagcugtt

SEQ ID NO: 2971 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gcuagcaucaggacagaaatt

SEQ ID NO: 2972 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
uuucuguccugaugcuagctt

SEQ ID NO: 2973 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gaaagguguccaaguaccutt

SEQ ID NO: 2974 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
agguacuuggacaccuuuctt

SEQ ID NO: 2975 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ccuaguggccagucccagatt

SEQ ID NO: 2976 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ucugggacuggccacuaggtt

SEQ ID NO: 2977 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cugucuggucaugaccccatt

SEQ ID NO: 2978 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
uggggucaugaccagacagtt

SEQ ID NO: 2979 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gucuggucaugaccccauutt

SEQ ID NO: 2980 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
aauggggucaugaccagactt

SEQ ID NO: 2981 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cugggaggaggcauugucatt

SEQ ID NO: 2982 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ugacaaugccuccucccagtt

SEQ ID NO: 2983 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ggaggaggcauugucacuutt

SEQ ID NO: 2984 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
aagugacaaugccuccucctt

SEQ ID NO: 2985 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
gcauugucacuucccaccatt

SEQ ID NO: 2986 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
uggugggaagugacaaugctt

SEQ ID NO: 2987 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ggacuugggguugaggugatt

SEQ ID NO: 2988 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ucaccucaaccccaagucctt

SEQ ID NO: 2989 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
cucuugcuggcaauggggutt

SEQ ID NO: 2990 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
accccauugccagcaagagtt

SEQ ID NO: 2991 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ccagccuggaaugugaagutt

SEQ ID NO: 2992 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
acuucacauuccaggcuggtt

SEQ ID NO: 2993 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
ggcagaguaaaaggugccatt

SEQ ID NO: 2994 - DNA, 21 bp, Artificial Sequence
  Description of Artificial Sequence: Synthetic iRNA agent targeting human EGLN2 oligonucleotide
  Description of Combined DNA/RNA Molecule: Synthetic iRNA agent targeting human EGLN2 oligonucleotide
uggcaccuuuuacucugcctt

SEQ ID NO: 2995 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
guggcagccgcagguuucutt

SEQ ID NO: 2996 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
agaaaccugcggcugccactt

SEQ ID NO: 2997 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
gcagccgcagguuucugaatt

SEQ ID NO: 2998 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uucagaaaccugcggcugctt

SEQ ID NO: 2999 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ggcuucgcgcucguguagatt

SEQ ID NO: 3000 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ucuacacgagcgcgaagcctt

SEQ ID NO: 3001 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
gcuucgcgcucguguagautt

SEQ ID NO: 3002 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
aucuacacgagcgcgaagctt

SEQ ID NO: 3003 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
cgcgcucguguagaucguutt

SEQ ID NO: 3004 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
aacgaucuacacgagcgcgtt

SEQ ID NO: 3005 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
gaucccggaccucgauucutt

SEQ ID NO: 3006 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
agaaucgagguccgggauctt

SEQ ID NO: 3007 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
caaggagaggucuaaggcatt

SEQ ID NO: 3008 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ugccuuagaccucuccuugtt

SEQ ID NO: 3009 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ggcaaugguggcuugcuautt

SEQ ID NO: 3010 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
auagcaagccaccauugcctt

SEQ ID NO: 3011 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ccgggaaauggaacagguutt

SEQ ID NO: 3012 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
aaccuguuccauuucccggtt

SEQ ID NO: 3013 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ccugcaucuacuaucugaatt

SEQ ID NO: 3014 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uucagauaguagaugcaggtt

SEQ ID NO: 3015 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
gauccugcggauauuuccatt

SEQ ID NO: 3016 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uggaaauauccgcaggauctt

SEQ ID NO: 3017 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ggggaaaucauucauagcatt

SEQ ID NO: 3018 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ugcuaugaaugauuucccctt

SEQ ID NO: 3019 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ggaaaucauucauagcagatt

SEQ ID NO: 3020 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ucugcuaugaaugauuucctt

SEQ ID NO: 3021 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
gacagacuccuguucuucutt

SEQ ID NO: 3022 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
agaagaacaggagucuguctt

SEQ ID NO: 3023 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ccuguucuucuggucagautt

SEQ ID NO: 3024 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
aucugaccagaagaacaggtt

SEQ ID NO: 3025 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
gcaaccagauaugcuaugatt

SEQ ID NO: 3026 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ucauagcauaucugguugctt

SEQ ID NO: 3027 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ccagauaugcuaugacugutt

SEQ ID NO: 3028 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
acagucauagcauaucuggtt

SEQ ID NO: 3029 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
cuaugacugucugguacuutt

SEQ ID NO: 3030 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
aaguaccagacagucauagtt

SEQ ID NO: 3031 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
gaaauucaggaauuuaacutt

SEQ ID NO: 3032 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
aguuaaauuccugaauuuctt

SEQ ID NO: 3033 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
gaauuuaacuaggaaaacutt

SEQ ID NO: 3034 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
aguuuuccuaguuaaauuctt

SEQ ID NO: 3035 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
gccuuguucauuuuaguaatt

SEQ ID NO: 3036 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uuacuaaaaugaacaaggctt

SEQ ID NO: 3037 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
guuccugaauucucuuaaatt

SEQ ID NO: 3038 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uuuaagagaauucaggaactt

SEQ ID NO: 3039 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
guuccugaauucucuuaaatt

SEQ ID NO: 3040 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uuuaagagaauucaggaactt

SEQ ID NO: 3041 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
cugaauucucuuaaauucutt

SEQ ID NO: 3042 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
agaauuuaagagaauucagtt

SEQ ID NO: 3043 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
caaagauggccucuucagutt

SEQ ID NO: 3044 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
acugaagaggccaucuuugtt

SEQ ID NO: 3045 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
cugcuacuucuugcauccutt

SEQ ID NO: 3046 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
aggaugcaagaaguagcagtt

SEQ ID NO: 3047 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
cccugucuugugugugguatt

SEQ ID NO: 3048 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uaccacacacaagacagggtt

SEQ ID NO: 3049 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
cuugugugugguacuucautt

SEQ ID NO: 3050 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
augaaguaccacacacaagtt

SEQ ID NO: 3051 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
gugugguacuucauguuuutt

SEQ ID NO: 3052 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
aaaacaugaaguaccacactt

SEQ ID NO: 3053 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
guuuucuugccaagacugutt

SEQ ID NO: 3054 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
acagucuuggcaagaaaactt

SEQ ID NO: 3055 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
cgagggaaugaaccuuacutt

SEQ ID NO: 3056 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
aguaagguucauucccucgtt

SEQ ID NO: 3057 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
cuuacuugcacuuuauguatt

SEQ ID NO: 3058 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uacauaaagugcaaguaagtt

SEQ ID NO: 3059 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
cacuuuauguauacuuccutt

SEQ ID NO: 3060 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
aggaaguauacauaaagugtt

SEQ ID NO: 3061 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
guauacuuccugauuugaatt

SEQ ID NO: 3062 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uucaaaucaggaaguauactt

SEQ ID NO: 3063 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ggagaauuaucacaaccuatt

SEQ ID NO: 3064 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uagguugugauaauucucctt

SEQ ID NO: 3065 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ccuaaugacauuaauaccutt

SEQ ID NO: 3066 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
agguauuaaugucauuaggtt

SEQ ID NO: 3067 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
cccugguaguuuuguguuatt

SEQ ID NO: 3068 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uaacacaaaacuaccagggtt

SEQ ID NO: 3069 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
ccugguaguuuuguguuaatt

SEQ ID NO: 3070 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uuaacacaaaacuaccaggtt

SEQ ID NO: 3071 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
guggaaagagcuaggucuatt

SEQ ID NO: 3072 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uagaccuagcucuuuccactt

SEQ ID NO: 3073 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
cuaggucuacugauauacatt

SEQ ID NO: 3074 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uguauaucaguagaccuagtt

SEQ ID NO: 3075 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
gucuacugauauacaauaatt

SEQ ID NO: 3076 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uuauuguauaucaguagactt

SEQ ID NO: 3077 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
caugugugcaucuugaacatt

SEQ ID NO: 3078 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
uguucaagaugcacacaugtt

SEQ ID NO: 3079 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
gugugcaucuugaacaauutt

SEQ ID NO: 3080 - DNA, 21 bp, Artificial Sequence
  Description of Artificial Sequence: Synthetic iRNA agent targeting human EGLN3 oligonucleotide
  Description of Combined DNA/RNA Molecule: Synthetic iRNA agent targeting human EGLN3 oligonucleotide
aauuguucaagaugcacactt

SEQ ID NO: 3081 - DNA, 28 bp, Artificial Sequence
  Description of Artificial Sequence: Synthetic Adaptor oligonucleotide
cgactggagcacgaggacactgacatgg

SEQ ID NO: 3082 - DNA, 27 bp, Artificial Sequence
  Description of Artificial Sequence: Synthetic Nested Adaptor oligonucleotide
ggacactgacatggactgaaggagtag

SEQ ID NO: 3083 - DNA, 35 bp, Artificial Sequence
  Description of Artificial Sequence: Synthetic EGLN1 GSP oligonucleotide
agagatgaaatgaactcagttaggtgacaggtctg

SEQ ID NO: 3084 - DNA, 35 bp, Artificial Sequence
  Description of Artificial Sequence: Synthetic EGLN1 PCR Primer
ttgtttcgtgtccagatggaaaagctactctcctc

SEQ ID NO: 3085 - DNA, 34 bp, Artificial Sequence
  Description of Artificial Sequence: Synthetic EGLN1 PCR Primer
ggcttgagttcaaccctcacacctttctcacctg

SEQ ID NO: 3086 - DNA, 28 bp, Artificial Sequence
  Description of Artificial Sequence: Synthetic EGLN2 GSP oligonucleotide
tatttcttggctggcagaacctccatac

SEQ ID NO: 3087 - DNA, 29 bp, Artificial Sequence
  Description of Artificial Sequence: Synthetic EGLN2 PCR Primer oligonucleotide
cagacagtggcagcccagtccatacactg

SEQ ID NO: 3088 - DNA, 32 bp, Artificial Sequence
  Description of Artificial Sequence: Synthetic EGLN2 PCR Primer oligonucleotide
cagcagaggtctctccttgttgctcctcagtg

SEQ ID NO: 3089 - DNA, 31 bp, Artificial Sequence
  Description of Artificial Sequence: Synthetic EGLN3 GSP oligonucleotide
gatgtggaagaactccaatagctctgaggtc

SEQ ID NO: 3090 - DNA, 35 bp, Artificial Sequence
  Description of Artificial Sequence: Synthetic EGLN3 PCR Primer oligonucleotide
cagtgctgaattaccaggaagctttctatcctctg

SEQ ID NO: 3091 - DNA, 29 bp, Artificial Sequence
  Description of Artificial Sequence: Synthetic EGLN3 PCR Primer oligonucleotide
gcaagaaaacatgaagtaccacaaacaag

The invention claimed is:

1. A double-stranded ribonucleic acid (dsRNA) for inhibiting expression of Egl nine homolog 1 (EGLN1), wherein said dsRNA comprises a sense strand and an antisense strand,
   wherein the sense strand comprises at least 15 contiguous nucleotides or chemically modified nucleotides differing by no more than 3 nucleotides or chemically modified nucleotides from a first chemically modified sequence set forth in
   cAAGGuAcGcAAuAAcuGudTsdT (SEQ ID NO: 88),
   and the antisense strand comprises at least 15 contiguous nucleotides or chemically modified nucleotides differing by no more than 3 nucleotides or chemically modified nucleotides from a second chemically modified sequence set forth in
   AcAGUuAUUGCGuACCUUGdTsdT (SEQ ID NO: 89),
   wherein c is 2'-O-methylcytidine, u is 2'-O-methyluridine, dT is 2'-deoxythymidine, and s is phosphorothioate linkage.

2. The dsRNA of claim 1, wherein the dsRNA comprises a region of complementarity between the sense and antisense strands, wherein the region is at least 17 nucleotides or chemically modified nucleotides in length.

3. The dsRNA of claim 2, wherein the dsRNA comprises a region of complementarity between the sense and antisense strands, wherein the region is between 19 and 21 nucleotides or chemically modified nucleotides in length.

4. The dsRNA of claim 1, wherein either one or both of the sense and antisense strands comprises a 3' overhang of at least 1 nucleotide.

5. The dsRNA of claim 1, wherein the dsRNA further comprises a ligand selected from the group consisting of a lipid, a lipid based molecule, a protein, an antibody, a peptide, a peptidomimetic, and a polymer.

6. The dsRNA of claim 5, wherein the ligand is conjugated to the 3' end of the sense strand of the dsRNA.

7. A pharmaceutical composition for inhibiting expression of EGLN1 comprising the dsRNA of claim 1.

8. The dsRNA of claim 1, wherein the sense strand comprises at least 15 contiguous nucleotides or chemically modified nucleotides of the first chemically modified sequence.

9. The dsRNA of claim 1, wherein the sense strand comprises the first chemically modified sequence.

10. The dsRNA of claim 1, wherein the antisense strand comprises at least 15 contiguous nucleotides or chemically modified nucleotides of the second chemically modified sequence.

11. The dsRNA of claim 1, wherein the antisense strand comprises the second chemically modified sequence.

12. The dsRNA of claim 6, wherein the ligand is a lipid or a lipid based ligand.

13. The dsRNA of claim 1, wherein the dsRNA is encapsulated in a stable nucleic acid-lipid particle.

14. A composition comprising
   (1) a first double-stranded ribonucleic acid (dsRNA) for inhibiting expression of Egl nine homolog 1 (EGLN1), wherein said dsRNA comprises a sense strand and an antisense strand, wherein the sense strand comprises at least 15 contiguous nucleotides differing by no more than 3 nucleotides from the nucleotide sequence of SEQ ID NO: 26 and the antisense strand comprises at least 15 contiguous nucleotides differing by no more than 3 nucleotides from the nucleotide sequence of SEQ ID NO: 27, and wherein the dsRNA comprises a modified nucleotide selected from the group consisting of: a nucleotide comprising a 5'-phosphorothioate group, a terminal nucleotide linked to a cholesteryl derivative, a terminal nucleotide linked to a dodecanoic acid bisdecylamide group, a 2'-deoxy-2'-fluoro modified nucleotide, a locked nucleotide, an abasic nucleotide, a 2'-amino-modified nucleotide, a 2'-alkyl-modified nucleotide, a morpholino nucleotide, and a nucleotide comprising a non-natural base; and (2) a second dsRNA for inhibiting expression of EGLN2 or EGLN3.

15. The composition of claim 14, further comprising an anti-cancer therapy.

16. The composition of claim 14, further comprising an angiogenesis inhibitor.

17. The composition of claim 14, wherein the second dsRNA inhibits expression of EGLN2.

18. The composition of claim 14, wherein the second dsRNA inhibits expression of EGLN3.

19. A method of inhibiting EGLN1 expression in a cell, the method comprising: contacting the cell with the dsRNA of claim 1, thereby inhibiting expression of EGLN1 in the cell.

20. A method of treating a disorder mediated by EGLN expression comprising administering to a human subject in need of such treatment a therapeutically effective amount of the dsRNA of claim 1.

21. The method of claim 20, wherein the human subject has anemia or a condition associated with anemia.

22. The method of claim 21, wherein the anemia is selected from the group consisting of anemia due to B12 deficiency, anemia due to folate deficiency, anemia due to iron deficiency, hemolytic anemia, hemolytic anemia due to G-6-PD deficiency, idiopathic aplastic anemia, idiopathic autoimmune hemolytic anemia, immune hemolytic anemia, megaloblastic anemia, pernicious anemia, secondary aplastic anemia, and sickle cell anemia.

23. The method of claim 21, wherein the condition associated with anemia is selected from the group consisting of pale skin, dizziness, fatigue, headaches, irritability, low body temperature, numb/cold hands or feet, rapid heartbeat, reduced erythropoietin, shortness of breath, weakness and chest pain.

24. The method of claim 20, wherein the human subject has a disorder selected from the group consisting of hypoxia, a neurological condition, renal disease or failure, a cancer of the blood, a cancer of the bone, and a cancer of the marrow.

25. A method of increasing erythropoietin levels in a human subject, the method comprising administering to the human subject a therapeutically effective amount of the dsRNA of claim 1.

* * * * *